United States Patent 9,592,283 (IMMUNOLOGICAL COMPOSITIONS CONTAINING ATTENUATED HISTOPHILUS SOMNI) - sequence listing, part 3

SEQ ID NO: 3 - DNA, 2263460 bp, Histophilus somni (TK #28)
  misc_feature (43157)..(43161): n is a, c, g, or t
  misc_feature (76981)..(77245): n is a, c, g, or t
  misc_feature (77445)..(77503): n is a, c, g, or t
  misc_feature (77559)..(78150): n is a, c, g, or t
  misc_feature (78208)..(78360): n is a, c, g, or t
  misc_feature (78861)..(78879): n is a, c, g, or t
  misc_feature (78916)..(78969): n is a, c, g, or t
  misc_feature (79494)..(79538): n is a, c, g, or t
  misc_feature (79658)..(79671): n is a, c, g, or t
  misc_feature (79953)..(80011): n is a, c, g, or t
  misc_feature (80480)..(80542): n is a, c, g, or t
  misc_feature (81127)..(81138): n is a, c, g, or t
  misc_feature (81367)..(81419): n is a, c, g, or t
  misc_feature (81478)..(81478): n is a, c, g, or t
  misc_feature (81577)..(82474): n is a, c, g, or t
  misc_feature (82840)..(83305): n is a, c, g, or t
  misc_feature (83598)..(85879): n is a, c, g, or t
  misc_feature (86014)..(86212): n is a, c, g, or t
  misc_feature (86327)..(86418): n is a, c, g, or t
  misc_feature (86744)..(86752): n is a, c, g, or t
  misc_feature (87011)..(87075): n is a, c, g, or t
  misc_feature (87403)..(87864): n is a, c, g, or t
  misc_feature (88112)..(88269): n is a, c, g, or t
  misc_feature (88329)..(88587): n is a, c, g, or t
  misc_feature (91812)..(91814): n is a, c, g, or t
  misc_feature (91964)..(92672): n is a, c, g, or t
  misc_feature (96616)..(98185): n is a, c, g, or t
  misc_feature (243183)..(243209): n is a, c, g, or t
  misc_feature (243263)..(243263): n is a, c, g, or t
  misc_feature (243580)..(250973): n is a, c, g, or t
  misc_feature (259183)..(259798): n is a, c, g, or t
  misc_feature (286449)..(286449): n is a, c, g, or t
  misc_feature (288452)..(288566): n is a, c, g, or t
  misc_feature (288646)..(289011): n is a, c, g, or t
  misc_feature (289594)..(289688): n is a, c, g, or t
  misc_feature (291020)..(291203): n is a, c, g, or t
  misc_feature (291242)..(293236): n is a, c, g, or t
  misc_feature (293432)..(295361): n is a, c, g, or t
  misc_feature (296637)..(297001): n is a, c, g, or t
  misc_feature (306132)..(306132): n is a, c, g, or t
  misc_feature (334146)..(336310): n is a, c, g, or t
  misc_feature (362551)..(363504): n is a, c, g, or t
  misc_feature (363651)..(363728): n is a, c, g, or t
  misc_feature (367039)..(367039): n is a, c, g, or t
  misc_feature (371510)..(371626): n is a, c, g, or t
  misc_feature (380991)..(381001): n is a, c, g, or t
  misc_feature (381071)..(381167): n is a, c, g, or t
  misc_feature (381397)..(381424): n is a, c, g, or t
  misc_feature (381652)..(381691): n is a, c, g, or t
  misc_feature (382320)..(382566): n is a, c, g, or t
  misc_feature (422691)..(423002): n is a, c, g, or t
  misc_feature (423737)..(423793): n is a, c, g, or t
  misc_feature (424286)..(424333): n is a, c, g, or t
  misc_feature (424555)..(424575): n is a, c, g, or t
  misc_feature (424782)..(424860): n is a, c, g, or t
  misc_feature (425085)..(425147): n is a, c, g, or t
  misc_feature (425182)..(425208): n is a, c, g, or t
  misc_feature (425303)..(425538): n is a, c, g, or t
  misc_feature (425943)..(426624): n is a, c, g, or t
  misc_feature (426771)..(426835): n is a, c, g, or t
  misc_feature (428778)..(428980): n is a, c, g, or t
  misc_feature (429495)..(429495): n is a, c, g, or t
  misc_feature (429742)..(429850): n is a, c, g, or t
  misc_feature (467773)..(468629): n is a, c, g, or t
  misc_feature (513650)..(518330): n is a, c, g, or t
  misc_feature (552622)..(553102): n is a, c, g, or t
  misc_feature (553297)..(553381): n is a, c, g, or t
  misc_feature (607124)..(607125): n is a, c, g, or t
  misc_feature (607255)..(607768): n is a, c, g, or t
  misc_feature (630147)..(630155): n is a, c, g, or t
  misc_feature (630230)..(634578): n is a, c, g, or t
  misc_feature (636476)..(636476): n is a, c, g, or t
  misc_feature (664961)..(665370): n is a, c, g, or t
  misc_feature (665529)..(665886): n is a, c, g, or t
  misc_feature (672465)..(677139): n is a, c, g, or t
  misc_feature (708739)..(709204): n is a, c, g, or t
  misc_feature (806834)..(806931): n is a, c, g, or t
  misc_feature (808315)..(810604): n is a, c, g, or t
  misc_feature (811652)..(811652): n is a, c, g, or t
  misc_feature (811654)..(811655): n is a, c, g, or t
  misc_feature (811674)..(811674): n is a, c, g, or t
  misc_feature (811691)..(811691): n is a, c, g, or t
  misc_feature (811703)..(811703): n is a, c, g, or t
  misc_feature (811819)..(812190): n is a, c, g, or t
  misc_feature (812249)..(812460): n is a, c, g, or t
  misc_feature (812525)..(815282): n is a, c, g, or t
  misc_feature (815473)..(815546): n is a, c, g, or t
  misc_feature (926933)..(928313): n is a, c, g, or t
  misc_feature (971205)..(971303): n is a, c, g, or t
  misc_feature (971725)..(971803): n is a, c, g, or t
  misc_feature (971987)..(972172): n is a, c, g, or t
  misc_feature (972280)..(972484): n is a, c, g, or t
  misc_feature (973802)..(973855): n is a, c, g, or t
  misc_feature (974176)..(974362): n is a, c, g, or t
  misc_feature (975074)..(975111): n is a, c, g, or t
  misc_feature (975332)..(975339): n is a, c, g, or t
  misc_feature (975372)..(975472): n is a, c, g, or t
  misc_feature (975745)..(975998): n is a, c, g, or t
  misc_feature (981649)..(981729): n is a, c, g, or t
  misc_feature (981832)..(983093): n is a, c, g, or t
  misc_feature (986042)..(990188): n is a, c, g, or t
  misc_feature (1004286)..(1004474): n is a, c, g, or t
  misc_feature (1007437)..(1007809): n is a, c, g, or t
  misc_feature (1007933)..(1007998): n is a, c, g, or t
  misc_feature (1008590)..(1009438): n is a, c, g, or t
  misc_feature (1014395)..(1014461): n is a, c, g, or t
  misc_feature (1015533)..(1016185): n is a, c, g, or t
  misc_feature (1021912)..(1022042): n is a, c, g, or t
  misc_feature (1022093)..(1022170): n is a, c, g, or t
  misc_feature (1022207)..(1022409): n is a, c, g, or t
  misc_feature (1031122)..(1031128): n is a, c, g, or t
  misc_feature (1031170)..(1031319): n is a, c, g, or t
  misc_feature (1031558)..(1032463): n is a, c, g, or t
  misc_feature (1032538)..(1032604): n is a, c, g, or t
  misc_feature (1036715)..(1037239): n is a, c, g, or t
  misc_feature (1041456)..(1041668): n is a, c, g, or t
  misc_feature (1047048)..(1047048): n is a, c, g, or t
  misc_feature (1047106)..(1047495): n is a, c, g, or t
  misc_feature (1050107)..(1050160): n is a, c, g, or t
  misc_feature (1070925)..(1071023): n is a, c, g, or t
  misc_feature (1090646)..(1090686): n is a, c, g, or t
  misc_feature (1090725)..(1090725): n is a, c, g, or t
  misc_feature (1090746)..(1090746): n is a, c, g, or t
  misc_feature (1090759)..(1090799): n is a, c, g, or t
  misc_feature (1114027)..(1115080): n is a, c, g, or t
  misc_feature (1115273)..(1115273): n is a, c, g, or t
  misc_feature (1115275)..(1115275): n is a, c, g, or t
  misc_feature (1169680)..(1169807): n is a, c, g, or t
  misc_feature (1169867)..(1169867): n is a, c, g, or t
  misc_feature (1170097)..(1170175): n is a, c, g, or t
  misc_feature (1170716)..(1170716): n is a, c, g, or t
  misc_feature (1175275)..(1175276): n is a, c, g, or t
  misc_feature (1176067)..(1176154): n is a, c, g, or t
  misc_feature (1188712)..(1195495): n is a, c, g, or t
  misc_feature (1303225)..(1303375): n is a, c, g, or t
  misc_feature (1306783)..(1307128): n is a, c, g, or t
  misc_feature (1307711)..(1307985): n is a, c, g, or t
  misc_feature (1314017)..(1314282): n is a, c, g, or t
  misc_feature (1321226)..(1323418): n is a, c, g, or t
  misc_feature (1340125)..(1352087): n is a, c, g, or t
  misc_feature (1368237)..(1368455): n is a, c, g, or t
  misc_feature (1382977)..(1387059): n is a, c, g, or t
  misc_feature (1391285)..(1399681): n is a, c, g, or t
  misc_feature (1417423)..(1419053): n is a, c, g, or t
  misc_feature (1419317)..(1419341): n is a, c, g, or t
  misc_feature (1419696)..(1419951): n is a, c, g, or t
  misc_feature (1421879)..(1421879): n is a, c, g, or t
  misc_feature (1422415)..(1422608): n is a, c, g, or t
  misc_feature (1422713)..(1422713): n is a, c, g, or t
  misc_feature (1422719)..(1422719): n is a, c, g, or t
  misc_feature (1426834)..(1426862): n is a, c, g, or t
  misc_feature (1427001)..(1427018): n is a, c, g, or t
  misc_feature (1427286)..(1427319): n is a, c, g, or t
  misc_feature (1428007)..(1428223): n is a, c, g, or t
  misc_feature (1428501)..(1428895): n is a, c, g, or t
  misc_feature (1428949)..(1429071): n is a, c, g, or t
  misc_feature (1429240)..(1429383): n is a, c, g, or t
  misc_feature (1429479)..(1430995): n is a, c, g, or t
  misc_feature (1433444)..(1436354): n is a, c, g, or t
  misc_feature (1441632)..(1441855): n is a, c, g, or t
  misc_feature (1443272)..(1443828): n is a, c, g, or t
  misc_feature (1444061)..(1444070): n is a, c, g, or t
  misc_feature (1528865)..(1529864): n is a, c, g, or t
  misc_feature (1530741)..(1532742): n is a, c, g, or t
  misc_feature (1534298)..(1534471): n is a, c, g, or t
  misc_feature (1534711)..(1534773): n is a, c, g, or t
  misc_feature (1535194)..(1535205): n is a, c, g, or t
  misc_feature (1652019)..(1652087): n is a, c, g, or t
  misc_feature (1653183)..(1653768): n is a, c, g, or t
  misc_feature (1653939)..(1654071): n is a, c, g, or t
  misc_feature (1654203)..(1654260): n is a, c, g, or t
  misc_feature (1654397)..(1654719): n is a, c, g, or t
  misc_feature (1689409)..(1689438): n is a, c, g, or t
  misc_feature (1689798)..(1689923): n is a, c, g, or t
  misc_feature (1692583)..(1692718): n is a, c, g, or t
  misc_feature (1692847)..(1693210): n is a, c, g, or t
  misc_feature (1693298)..(1693456): n is a, c, g, or t
  misc_feature (1693525)..(1693594): n is a, c, g, or t
  misc_feature (1693678)..(1693813): n is a, c, g, or t
  misc_feature (1694052)..(1694129): n is a, c, g, or t
  misc_feature (1694388)..(1694412): n is a, c, g, or t
  misc_feature (1694497)..(1694614): n is a, c, g, or t
  misc_feature (1695063)..(1695129): n is a, c, g, or t
  misc_feature (1747818)..(1748949): n is a, c, g, or t
  misc_feature (1749030)..(1749384): n is a, c, g, or t
  misc_feature (1752075)..(1754121): n is a, c, g, or t
  misc_feature (1769847)..(1769975): n is a, c, g, or t
  misc_feature (1770098)..(1770829): n is a, c, g, or t
  misc_feature (1770917)..(1771796): n is a, c, g, or t
  misc_feature (1771872)..(1771917): n is a, c, g, or t
  misc_feature (1774054)..(1774175): n is a, c, g, or t
  misc_feature (1775011)..(1775097): n is a, c, g, or t
  misc_feature (1807130)..(1808779): n is a, c, g, or t
  misc_feature (1809250)..(1809250): n is a, c, g, or t
  misc_feature (1809253)..(1809253): n is a, c, g, or t
  misc_feature (1809263)..(1809263): n is a, c, g, or t
  misc_feature (1809272)..(1809272): n is a, c, g, or t
  misc_feature (1809287)..(1809399): n is a, c, g, or t
  misc_feature (1809502)..(1809773): n is a, c, g, or t
  misc_feature (1812820)..(1812976): n is a, c, g, or t
  misc_feature (1813846)..(1813932): n is a, c, g, or t
  misc_feature (1814009)..(1814017): n is a, c, g, or t
  misc_feature (1814212)..(1814381): n is a, c, g, or t
  misc_feature (1814448)..(1814500): n is a, c, g, or t
  misc_feature (1814859)..(1814968): n is a, c, g, or t
  misc_feature (1815142)..(1815283): n is a, c, g, or t
  misc_feature (1815477)..(1815535): n is a, c, g, or t
  misc_feature (1815617)..(1815919): n is a, c, g, or t
  misc_feature (1816071)..(1816153): n is a, c, g, or t
  misc_feature (1816189)..(1816189): n is a, c, g, or t
  misc_feature (1816480)..(1816586): n is a, c, g, or t
  misc_feature (1817524)..(1817682): n is a, c, g, or t
  misc_feature (1865855)..(1866896): n is a, c, g, or t
  misc_feature (1869358)..(1869790): n is a, c, g, or t
  misc_feature (1870894)..(1871342): n is a, c, g, or t
  misc_feature (1871668)..(1871959): n is a, c, g, or t
  misc_feature (1872655)..(1873082): n is a, c, g, or t
  misc_feature (1873323)..(1873967): n is a, c, g, or t
  misc_feature (1874215)..(1874469): n is a, c, g, or t
  misc_feature (1875511)..(1875621): n is a, c, g, or t
  misc_feature (1875918)..(1877886): n is a, c, g, or t
  misc_feature (1882950)..(1885665): n is a, c, g, or t
  misc_feature (1885798)..(1885957): n is a, c, g, or t
  misc_feature (1892371)..(1895192): n is a, c, g, or t
  misc_feature (1902581)..(1902691): n is a, c, g, or t
  misc_feature (1922565)..(1923442): n is a, c, g, or t
  misc_feature (1927919)..(1929691): n is a, c, g, or t
  misc_feature (1930075)..(1931450): n is a, c, g, or t
  misc_feature (1931572)..(1934252): n is a, c, g, or t
  misc_feature (1934452)..(1935559): n is a, c, g, or t
  misc_feature (1935858)..(1935858): n is a, c, g, or t
  misc_feature (1935983)..(1938807): n is a, c, g, or t
  misc_feature (1939133)..(1941154): n is a, c, g, or t
  misc_feature (1941211)..(1941429): n is a, c, g, or t
  misc_feature (1941693)..(1942580): n is a, c, g, or t
  misc_feature (1942951)..(1944376): n is a, c, g, or t
  misc_feature (1944839)..(1944981): n is a, c, g, or t
  misc_feature (1945402)..(1945660): n is a, c, g, or t
  misc_feature (1945816)..(1945884): n is a, c, g, or t
  misc_feature (1946112)..(1946112): n is a, c, g, or t
  misc_feature (1946313)..(1949237): n is a, c, g, or t
  misc_feature (1949645)..(1950692): n is a, c, g, or t
  misc_feature (1950986)..(1953259): n is a, c, g, or t
  misc_feature (1953761)..(1955895): n is a, c, g, or t
  misc_feature (1955958)..(1956036): n is a, c, g, or t
  misc_feature (1956076)..(1956174): n is a, c, g, or t
  misc_feature (1956302)..(1962048): n is a, c, g, or t
  misc_feature (1962186)..(1962322): n is a, c, g, or t
  misc_feature (1962668)..(1962771): n is a, c, g, or t
  misc_feature (1963025)..(1963251): n is a, c, g, or t
  misc_feature (1963655)..(1964161): n is a, c, g, or t
  misc_feature (1964228)..(1964300): n is a, c, g, or t
  misc_feature (1964384)..(1966015): n is a, c, g, or t
  misc_feature (1966061)..(1970407): n is a, c, g, or t
  misc_feature (1971089)..(1972239): n is a, c, g, or t
  misc_feature (1972516)..(1975765): n is a, c, g, or t
  misc_feature (1975891)..(1979302): n is a, c, g, or t
  misc_feature (1979561)..(1979567): n is a, c, g, or t
  misc_feature (1979639)..(1986573): n is a, c, g, or t
  misc_feature (1986959)..(1987495): n is a, c, g, or t
  misc_feature (1987560)..(1987730): n is a, c, g, or t
  misc_feature (1987883)..(1991559): n is a, c, g, or t
  misc_feature (1991713)..(1991782): n is a, c, g, or t
  misc_feature (1991961)..(1992221): n is a, c, g, or t
  misc_feature (1992327)..(1994518): n is a, c, g, or t
  misc_feature (2024461)..(2024488): n is a, c, g, or t
  misc_feature (2038955)..(2039011): n is a, c, g, or t
  misc_feature (2041460)..(2042226): n is a, c, g, or t
  misc_feature (2042409)..(2042515): n is a, c, g, or t
  misc_feature (2042679)..(2042833): n is a, c, g, or t
  misc_feature (2043069)..(2043510): n is a, c, g, or t
  misc_feature (2043685)..(2043968): n is a, c, g, or t
  misc_feature (2044168)..(2044869): n is a, c, g, or t
  misc_feature (2045181)..(2045344): n is a, c, g, or t
  misc_feature (2119023)..(2123308): n is a, c, g, or t
  misc_feature (2124903)..(2126281): n is a, c, g, or t
  misc_feature (2138555)..(2138700): n is a, c, g, or t
  misc_feature (2165780)..(2168495): n is a, c, g, or t
  misc_feature (2178030)..(2178736): n is a, c, g, or t
  misc_feature (2178941)..(2178986): n is a, c, g, or t
  misc_feature (2179216)..(2184376): n is a, c, g, or t
  misc_feature (2217530)..(2217640): n is a, c, g, or t
atcaaaaacaacgctcatcaaaaattaagaagcggaattctaatcttaaattcagcgttcgtcaaatcagaatagtcaaaatcgcagaataaagcttattttcccaatcaaaaagcacaagagcggctcggattatacgtttttttacaaaaatctcaagcaacctttttcagtttttttgttcttttaataaagatctttgagccagtttattgtagaattaccgtcaatttacaccgcacttttagataaaacttccaactatttaatttgcaaagatggataaaatgagttcaacagtttctacgctatggcgagattgcttattacaattacaagatcaagtatcttcaaatgactttacgacttggctacgaccattacaggacgatgtcagtgagagtaacatgatactttatgcaccaaattgtttcattaaaggatgggttgaaaatcattatctcactcaaatcacaaagcttgctcagcaattgttgaataatgatcaattcatggtaaagatacaagacggcataaaacctactgagaaaacaacaacgaatgttgagcaaaagacacaaaatgaaaactgtcataatgaaataacttcgcaacaaaattaccgctcttatctcaataaaaatcatgtctttgataactttgttgaaggtaaatccaaccaattggcacgagcagttgcccagaaagtggctaaaaatccgggtgagcaaagtgctaatccattgtttttgtatggtggtacaggtctaggcaaaacgcacctgttgcatgctgtaggaaacggcattttagcaaataatcctcatgctcaagttgtttatatgcatgcagaacgttttatgcaatcttatgtaaaagccttaaaatccgatagaatggacagttttaagcgattttatcgtactgttgatgccttactgattgatgatattcaattttttgccggtaaagatggtacgcaagaagaatttttccatatattcaactcgttatttgagcgtggtcgccaaattattttgacttctgatcgttatccgaaggaaattgagaaaattgaagatcgtttaaaatctcgtttcggttggggaattagtgttgctattgaacctcccgaattggaaaccagagtcgcgattttgttgaagaaagcggaagaaaaaaatatggttttacccgaagaggttgccatgtttattgggggaaaattacgtactaatgtgcgagaattagaaggtgcattaaaccgtgttcatgcacatgcggaatttaccggaaaagcgattaccattgattttgtacgtgaaactctaaaagacatgttggcattgcaagataaattggtaacaattgaaaatattcaaaaaattgtggcggattattatcggatcaaaatttcggatttaaaatcaaaaagacgctcacgtaatataacccgaccacgtcaattagctatggcattagctaaagaactaacgaatcgcagtcttcctgaaattggtaggaatttcggtgatcgggatcatacgaccgttctgcatgcttgtaaggccatagcaaaactccgagaagaagataatggtatccaagaagattggtcaaatttaatccgcacactgtcagtataagggagcagactatgcaatttattgtttcaagagaacatctattaaaaccattacaacaagtttgtggtgtattaagtagtcgtccaaattttcctatattaaacaatgtattattgcaaattgaggggaatgttttacgtattaccggtacagatctcgaagtagaactttcaacacaagcacaacttattcaagcatcgcaagacggtagttatacgattccggcaaaaaaattcttagatatttgccgcagttttcccgatgaagcggaaattactgtaatttttgaagaagagcgtgcattggtgagatccggtcgaagtaaatttaatttaaccgctttacctgcagacgaatatcctaatttagctgattggcaatcagaggtggatttttacctgcctcaaagtacattacgtcgcctaattgaagcaacacaattctctatggcaaaccaagatgctcgttatttcctaaacggtatgaagtttgaaactgaaggcaatttactacgaacagttgctactgatggacatcgactcgccgtttgcacaattccgttagagcaggatttgcatacacatgcagtcattttgcctcgcaaaggaatattagagttaatgagattactggaaaacagcgaacacgctgctcacgttcaaattggcacaaataatttacgcattgatttaggaagtattatttttacatcaaaattaattgatggtcgtttcccagactatcgtagagttctcccaagaaatgcaactcatattatggaaggtaattgggaactgctgaaacaagcttttgctcgtatggcaattctgtctagcgataaagttaaaactgtccgtttgcaattgacctcaaatcaattaaagattacagcaacaaatccggaacaagaagtggctgaggaaattttagatgtcatatataatggggcagatatggaagttggctttaatgtaagttatattttagatgtacttaatgccctaaaatgccaacaggtgcgattatgttttactgatgcctcatcaagttgtttattagaggatgctgatgatgaaagtgcagagtatgtcgttatgccgatgcgtctataaacaatggcaatatcacgcttaatcatcaatcatttccgcaacttaacagccatagatctggagtttgaacgtggctttaactttattattggcaacaatggaagcgggaaaacaagtttactggaagctattttttatttagggcatggacgctcatttaaaagtgcggttgcaaatagaataatttcttatcagcaaccgcactttattttacatggtaaaattcaagagcaacaacatcaatggtctgttggtttgcaaaaacaacgtcaaggtaacactttaatgaaaataaacggcgaggacgcaaaaaaaatttccgatcttgcccatttattgcccatgcaactcattacacctgaaggattaaccttattaaatggcggtcccagctatcgaagggcttatttagattgggggttatttcatcataacgcatcattttataatgcttggagtagcttaaatcgtttacttaaacaacgaaattctgccttacaacaagtttgttcttatgaaaaactcaaaatttgggatagagaattaaccaaacttgcttatcaagtgagctactggcgagaagcgtatgcggaagctttacgctcggaaatagaaaagacctgtcagctttttctacctgaactagaaatttctgttagctttcatcaaggctgggataaaaatatggactatgcggatctgttacaacaaaactttgagcgagatcgtgctttgggttataccttttccggacctcaaaaagcagattttcgttttaaagcaaacggattgccggttgaagatattttatctcgtggacaattaaaattgttaatgtgtgcattacgtttggctcaaggtgagcatttaatgcaacaaaaaaaacgccactgtatttttctacttgacgatttcgcttcagaattggaccaatataaacgcacattgcttgctgaacgcttacaaaaaaatggttcgcaagtttttgttactgcaataactcaagaacaattacaacagatacaaccagaaaagcaccgcactttttaccttgaaaacggaagaataaaagatctttaaaataagcaaaaaacaaacctgaccaattgtcaggcttcacatagcgttataaagatttatcttgtaccatacacaacaatagttttgccatgtgctgaaatcaaatgctgatcttctaacattttcaaaatacgcccaacagtttctcgtgagcaacctaccatttgtcctatttcctgacgagtaattttaatttgcataccgtccggatgagtcattgcatcaggcatcttagctaaatttaacaaggtttgagcgatacgacctgtcacatctaaaaatgccaaattgcttacctgctttgaagtattttgtaaacgatgagctaattgaccggctaaatacattaaaatttctggattaacttgaattaattggcgaaattttttataagaaatttctgcaatttcacatgagcttttagctttaacccaagccgaacgaggctgtgtttcatcaaataaaccagcttcgccaaaaaaatcaccttgacttaaataagtcaaaatcatttctttaccttcctcatcttttaccatcacggcaacagaccctctaattaaataataaagggtttccgccttttctccagcatgaatgagggagctttttgctgagtatttatgaatgtgacaatgagataggaaccactctaacgtcggatccatcgatggtgctgattgtccttgttgttctaacataaaatctcctagtcattttccatttaaaaaatccattttatttttaatattaatggattgatgtaactcagaccaaaccagtatcgctttcccctgacgaatgtttttaaataaattttctcttttttcggctaatgaaagctcggtactaccataatccgtaccttcacgtaaaataaagctatccacaatatttaataaggtttgctcttctaatttttcccatggaataagcattgcaaattgctccaatcttacctaaaaatttctattatgcaaataaactttccagcagtttccattgttgctcaaaaccttgattaggcaagtgcctaaagttatttcttacgtaacgcataaactgtccttcgcataaagtaacaagatgggaagcaataattttttcatcaagatgaaaagattttccttctctcaatttacgcatttgtagaatattcacaaactgtaattctaaacgatcaaaaaatcgtgcaactcgtgcttgtaactgactatcttcaaacattaaagcatgccctgttaaaattcgggttaatcccggattttttcgtgcaaaatcaagaatagtttgcaaaatatctctcacacgattcatggtattggtttcgttcttgatagagtgattaattcgactaaataaagtattttctatattatccaataatgcttcaaacattttggttttactgggaaaataacggtaaagtgcggcttcagaaacaccgacttcctgtgccaagcgagctgtcgtcatacgctccattcctcgttctgaatgtaacatatgggttagtacggttaatacctgttgacgacgttcttttactgttcgtttctcaattttttgcgttttttgttttgaggcaacaacgatttcagcatcgccaatatccaattgctgttgttccattattttttgcctgaatgaccaaaaccaccattaccacgatctgtttgctgaaattcttctacaatattgaactcagcttgtactacaggtacaaacactaattgtgcgatacgatcaccaatttcgattttgaaaggtttatcacttcgattccaaagagaaaccatgagtggaccttgataatctgaatcgattaaaccaactaaattgcctaatacaatcccatttttatgtcccaatcctgaacgaggcaaaatcactgctgctaaattaggatctgcaatataaatagataaacctgttgaaataagttttgtttctcctggctggacttcaaatccctcgtcaaccaacgctcgtaaatccaatcctgccgatcctatggttgcataagttggtaatggaaactcagttccaatacgtggatctaaaatttttacatcaatctttttcatttactttcttccaatttccatttataacgcacaataattttatcaaccaattgtttagctaagtcacttttatgtttcaatgtcaacctctcttgcccattttgccaaaacagctgcaatgcgttttgctctgaattaaatacttgcccaccggaaacatcatttgcacaaatcatatccaaatttttacgttgtaatttgtctttcgcatactgctccacattttgtgtttcagccgcaaatcctacaacaaaaggacgattttccattaaattggctacagttgcaagaatgtctggatttttgaccaactttaagaccatttcatcattaccggggattttcttaattttttgttctgcaatttgttctacacgataatcagctaccgctgcacaaccaataaaaatctgattttgttccgcactttgtattgcatgttgatacatttcttgtgccgaaactacattaatgcgttgtacattatgaggtgtcgctaaattgacaggtccactgattaaagtgacttttgcacctcgttgagcaaaagcttcagcaatagcaaaccccattttgcctgagctatgattactaatatagcgtaccggatcaatggcttctcttgttggacctgcggtaatcacaacacttacatcaagtaaatcttgagtatgtaaaaaggattggcaaagtgcggtaaaaatttcaaaaggttctgacattcttccgatacctacatcaccacaagcctgttcaccactattcggtccgataaactgcacaccacgagccatgagttgtgctaaattttgttgagtaacagtttgtgcatacatttgttggttcattgccggagccagaaaaattggagaattcgttgctagacaaatagtggataataaatcgtttgccataccgaccgccatgcgtgcaataaagtctgcactggcaggtgcaattacgataagatccgcccacttagccaattcaatatgtcccattgccaattcagcttcatgatcaagtaaagattgtgatacagcgttgccggaaattgcttgtaaagttaaaggtgttacaaattctgtcgctgcatttgttagcactactcgaacttctgcttgtgctttacgcaataaacgaattaattctatggttttatatgcagcaataccgccggtaattccaatgacaattcgttttccccgaataagattttgcattgttagtccttaatcacaatccaaagtgcggtcattttactgcaatttttcataagaaaacatttaattttgcgattttgcacgcaaaataaaaaatacagtatttaaaacagcaacaaatcccttcatctttatcgttaaatattttttcctttgctaacaagaattttctatgacacaacaaaatacaactttaatgccgagagaaaaactactgaaatatggagcttcatcacttgatgataaggaattattagcgattttcttacgtacaggtataaaaaattgtcctgttatgcaactctccgagttggtacttgctcatttttcttctttaagaggattaattaatgcagatcaaaagcatttttgccaaatgaaaggattgggtattactcaatttgtacaattacaagcctgtactgaaatgaccaaacgttatctcttacaagaattacagtttgcacaagaatttaccagccctgatacggttcgtatgtatttacagactgaattggaaaataaagatagagaaatttttatggtactgtttttggataatcaacatcgtttaataaaaaaagaggaaatgtttttaggtaccattaaccaggcaaatgtttatcctcgtgagattattaaaaccgcactattttgtaatgcagccgcacttattcttgcacataatcatccttccggtgtttcaacgccaagcatggcagacagaaaaatgaccgagaatataaaacaactatcagaattaatggaaatccgtgttttagatcattttatcattggtaaaggtaactatttctcctttgcagaacaaggctggatctaggataattcgatgaattattcaatctatttgcgtaaatttttatcatttttttcagtgaatttatctatttaggcttgagaatgataaacaaaggtcgtataattcacgacctttaatatagtgggtcggctatgcgacctgacgaggtagccttcaaaatcttgaattttgaagtggtccgaaccctaagctcgagcttatatttttattggagattaatatgtctagagtctgtcaagtaacaggcaagcgtccagcagttggtaacaaccgttcgcacgcaatgaatgcgactcgtcgtcgttttcttcctaacttacacactcaccgtttttgggttgagagtgaaaaacgtttcgtaactttacgcttaacagcgaaaggtatgcgtattattgataaaaaaggcattgatgcagtgttggctgaaatccgtgctcgtggcgagaaaatctaaggagctaaaaaatggcagctaaaggtgctcgtgaaaaaattcgcttagtttcaacagctgaaacaggtcatttttatacaacgactaaaaataaacgcaatatgccggaaaaaatggagatcaaaaaatttgatccggttgtgcgtaagcatgttatttacaaagaagctaaaatcaaataatttagttttcacgataaaaaagcccgacatgttcgggttttttattttttcaaattttactttttgccataagatagctgaaagacttactcttggaaaaaaaatatgcctgaattacctgaagttgaaacaaccttaaagggcgtaagcccttatttaaaagggtttataattgaaaaaatagtagtacgtaatcccaaattacgctgggaagtaagtaaagaactcagcacatttaaacacgttaaaattcttaacttaactcgtcgagccaagtatctcattatccacacggaacaaggttacattatcggacatttaggtatgtccggttcagtccgcattgtgccgcatgacaatcctgtcaataagcatgatcatttcgatattgttatgaacaacggcaagttactacgctataacgatgctcgtcgctttggtgcttggctatggacgaataaccttagtgaatttcatctttttttcaagttggggtcggaacctttatctgaaacgtttaattctacttatttgttcaaaaaatctcgtcaaaaaagcaccgcacttaaaactttcttgatggataattccgttgttgtaggggttggaaatatttatgcgaatgaaattttatttctatgtggacttcatccacaaaagatcgccaaaacattgacaaaaaaacaggctgaacaacttgttttcactattaaacaagtgcttaacgaagctattgaacaaggaggaacaaccctaaaagattttttacaacctgacggtcgccccggatattttgctcaaaaacttttggtttatggaaataaggacaagccttgtccaaggtgcggtacaaagataaaaagtattattattgggcaaagaaatagctttttttgtccgcaatgtcaaaaaaagtgacattactttctttgttttttaaaaaaaatatgttaaacatcaataatgtctttttattttcacaatcagtaaacgcaaaaaggaatatgtaatgaatggagcaaatttggtcgtagaatgtttaaaagctcacggcgtaacttccttatttggctatcccggtggggcgataatgccagtttatgatgcaatttatgattctggtttagatcatctactttgtcgtaatgagcaaggtgcagcaatggctgctattggatatgcaagatcaacaaataaagtcggtgtttgtgttgcgacgtcgggaccgggggcaacaaatttaattaccggtttaggtgatgccttgatggattcaattcccattattgcaattaccggacaagttgcctcaaattttattggtacagatgctttccaggaagctgatattcttgggttgtcacttgcctgtactaagcacagttttatcgttcaacatattgatgaattacctgaaatcattgctaaagctttccaaattgcacaaagtggtcgtcctggtcctgtgcttattgatcttccaaaagatgtgcaatttgcacctacatccttaaaacccattgtttatcccaaaattgcggattctttacaaaatttagtcgcacttgagcaagcgaaaaatttactttctcaagcaaaacgccctgtgctttatgtaggtggcggtgttggaatggcaaaaagctcggatggtatgagtggcgtaaaagctatacgcacttttcttgatataacaaatattccgtcagtatcaaccttaaaaggtttaggaacaatacctcccaaacatccactctatatgggaatgattggaatgcacggtacaaaagcggcaaattatgctgtgcaagaatgtgatttacttattgcttgtggggcaaggtttgatgatcgtgtaacgggaaaattagatacgtttgcaccacatgctaaagttattcatattgatattgatgttgctgaaattaacaaactccgtaaagcagatgttggactacaaggggatttggtggaggcggttactaaccttgcccaactattggatattgaaccgtggcgtaaagatattgagcagttaaaagcaagttttgattttaattatattgaaaatacagaagataaagagatagagccctgtgcattacttcacacattatccgaacgcaaagcaaaaaatgcggtgattacaactgatgtagggcaacatcaaatgtggtcggcacaacatatgaaacattatgaacctgaaaattatattacatctgcagggttcggttcgatgggcttcggtttgccggcagctatcggtgcggcaaaagctcgtccccaagatccagttattttaattactggtgatggctcattgatgatgaatattcaagaattgggttcgatcaagcgtggaaatttaccaatcaaaattttattgcttgataaccaacgtttgggtatggtgcgacagtggcaatcgctcttttttcatggtcgccatagccacactgttttagatgataatcctgattttgttactcttgcttctgcctttggtattgcaggtgaacgaattgaaaaggcaagtgaagtttccgatgctttggatcgattattaaatgccaaagaagcttatttactacatgtctgtatcccagatgaagaaaatgtatggccacttgtaccgccaaatacatgcaacagtaatatgattgaagaagatattggggtgtaaacaatgaaaacttacgatttaactattcaagcaaacaaacgccctgaaactttagagcgtttgttaagagttgtccgccatcgtggttttgaagtcattattctacatagtgaaagtaaaggtaatgttattgatttgagacttactgtgcaaagtgagcgagctattgaattattgattcatcaattagtgaaattaccggatgttattacattaagctaaagaacggtctaaatttgtataaattattatacaaaatagatggttagtttaaagggagataagttgtggaaggtgctgttttagcgattaaattgggattggttgaagagattgtttttgaaaatggttcaaagatgtcaacggcaattcggaagaaaccgatggaacaagctatcgttcatgaattaggtgcggaaggaaatgatgttggactgaaagcacatcatggaggcattgataaagcactgttttttatggctgaaagatcttttgctaaattaaccgctcttttgggtaagcatgatagctatcaaggagaagctatctatggtgaaaattttattgtttctttttttgatgaagaaaatgtatgtgtcggcgatcagtaccagatcggagatgtacaaattgaaatttcacaacctcgcataccttgtgaaatgttgtcaaaaaatgccaataataaaaatactcgagcgattgttgtagaaacagggctgaccggttggtatgtgagagtcattaaaaatggcgtgatcaaaaaaggggataaaatccggcgtttagctaacccttacccaaaattaaccattaaatatttaaattatttgctggcaacggaagcgactgtggagcttaaaactcaattagaacaagcaattgaatgtcctgttttggcggaggcttttaagcgttacttaaaaatgaaatggcgaaaaatcagttaaatatttggttaagtgagatattattaatcggcttatgtgaagaataaagaacgtgattaaatatttactgatataatggcgaaaatttttcagataattttaacaagcggtctctaattttgaatatttctttatttcgacaaattctctcctctacaaaatggcagaatgatatttttactttatccccgcaaaaacaagattggctattacatcaaggttcattaacccgaaaattacagcaatattgtcagcaactgaaagttgaaattgtggcggaaaaatgggtttctgacatgtcttttggatttaccggacatcatgagccaatttggttgcgtgaagtgatattaaaaggtgatgagcaagcttggatttttgcacaaactcgtttgccacaatctacgattgagaatgttgcacctgacattatcaatgtaggttcaacgcctattggcttatggcttttccctcaacaaccaaaaagaaaaacacttgaatggatatacgataccgcaacaggattatatgctcgtcgttcagtattgcttttaaatcaatatccaatcgaaattaaagaattgtttttgcaagattttaaattttttcaatcaaaggtctaaagcatgagaaccccgaaaaagacaaacaaaaaagcgaaaaaaatcaccgcacttacagaagatccgtattttttccaagagcaacagaaatatgctaatccaatcccgagtcgagagtttattttacaaattattcgtgattttaatgcacttatgtcgaaagaagatctgttcaagacattggctatcgttgatcctgaacaaaaagagggaatgcgtcgccgtttgcgtgcaatggaaaatgaagggcaattggtctttactaaaagaaagtgttacgccttgcctgaaaaattggatttattaaaggggtcagtgattggtcatcgtgaaggctatggttttttacaaatcgaaggaagcaagtcagattggtttattccaaatattcaaatgcaaaaagttatccatggtgattttgtattggcacaacctaatggctatgaccgtaaaggacgttcagaggtgcgtattgttcgagtgttagaaagtcgcaataaacatattgttgggcgttttttcatggaggaggggattggttatgtcgtgccggatgatagccgtattaatcgtgacattctgattccgaatgagtttcgcaacggagcgagaatgggacaggtagttgtggttgaacttaaacctcgtacagcaacatttacgcagttggttggaaaaattgtagaaattcttggggagaatatggcaaagggaatggaaactgaaattgctattcgcaatcatgatattcctcatatttttccaagtgcggtagaaaaacaagtaagaaaatatacggatagtgtgccggaggaagcaaaacaaggacgaagagatttaagaaccttaccattggtaaccattgatggtgaagatgcacgagattttgatgatgcggttttttgtcaaagaagtggtgatggcgggtggacattatgggttgccattgccgacgtgagctattacgtacgtttgcgtactgcattagataacgaagcatatcagcgtggcaattcggtttactttcctaaccgagttgtaccaatgttgccggagattttatcgaatggattatgttcgcttaatccacaggttgatcgtttgtgtatggtatgtgagatacgaatttcgccacagggaaaaatgactgattacagtttttatgaagcggtcatgaactcatatgcaagattaacttacactaaagttgcacaaattttggcaggtgatgaattattacaacaacgctatcatgttttagtaccgcacttacaagaattgcaccaaatgtatcaggctctgctgcaagctcgttatcagcgtggagccattgattttgaaactattgaaactaagtttatcttcaatgaaatgggacgtattgaatgtattgaacctatggtgcgtaacgatgcccataaaatcattgaagaatgtatgattttagcaaatattgcagcagctaattttatggaacgtcatcaagaacccgctttattccgtattcatgccggaccaagtcaagaaaaactcagtgcatttcgtgcttttctacgtgaatgtggcttaacgttaaaaggtggtataaaccccacaaccgcagattacgcacagttgttagcccaagttcgtgaacgtccggatcatgaattaattcaaactatgctacttcgttcacttagccaagctgtttatcaccctgataatattggacattttggtttagcactaacggaatatgcacattttacttcgcctattcgccgttatcctgatttaacgttacatcgtagtatcaaatatttattagcaaaacagcaaggttctaaaagaaaaacaaccgataccggcggttatcattattccctagaagaaatggatcttctcggtgatcattgttctttaaccgaacgccgagctgatgatgcaacaagagaagtggcagattggctaaaatgcgaatatatgcaagatcatgttggagatgaatttgacggtattatttcttccgtaaccggttttgggttgtttgtgcgtttagatgatttatttattgatgggctagttcatatttcaaccttagataatgattattatcaatttgactcaataaaacaacgtttaattggggaaaattccggtacgacttatcgtctcggtgataaagttaaaatccgtgttgaggcagtcagtttagctcaacgccaagtggattttgttttattatcgagtcagcgtaaacctagacgttccggcaaaacggcgaataagcgagcgaaacaaaaaagcttccaagaaaagaaccgcacttctaagatcgagcgacataaaagtgcggtaaaaataacaaaaaaattatcaaaaaaacaacaaagtccggcaagtaaaacaagaaaacagaaaaaacagaaaggataaaaaatcatggcagaaaatatttatggaattcatgcggtgcaggcttttcttattaatgcaccagaacgtttgatcgaagtttatgtgctaaaagggcgggaagataagcggttacaatccgtactgaatgagctttataaattaggtataagcgtacaatttttgaatcgtgatacattggataaaaaagcgaacggagaagtacatcaaggtatcattgctcgtgttcaaccagctaaagagttgaatgaaaatgacttggttgagatcttacaaaaaaaagcaaatccattattgctggtattggatggtatcacagatccgcataatttaggtgcttgtttacgatcagcagatgctgccggtgtttgtgctgtgattgtgccaaaagataaatcggcacaattgactgcgattgctcgtaaagtcgcttgtggagcggcggaagttgttcctcttgttcgtgtaacaaatttagcccgcactttacgagatctacagcaacaacataatatttgggttgtaggtacggctggcgaggcgattgaaactttatacgaagcgaaattaaccggcggtttagcacttgttatgggggctgagggagatggaatgcgtcgtttaacccgtgaaacttgcgatcaattgattagcattcctatggcgggttccgtatcttcattaaatgtttctgttgccacaggcatttgtctatttgaaattgtgcgacaaagattaggataatactttcttaatctaaaaaggttggatgtgatgtgaaatatatttattatgtaaattaaaaggactgaaccctgcagaatacagagtgcagtccttgaattaaatcagtccaatcagatcatattgtcaggaaatttttgctattttatacccttcttgtctagttttgcatacgtttgacagccaatgtttaagccattatcgcacgctaatctataatattgtttagctttagaaacatttctttgtacactctgtccgttttcatacatcacgccgagattgtgttgtgcatttgcatctccctgttcagccagttgtttgaataagggaaatgcgtcagaataattttgttgtttaataaattgtaaagcacgattaaatctttcggtatctgtttcggcaagtgtagattggacaataccgaaagagagtagggcggtaaggagggatttttttagattcatcagagctcctttgttgactgcttctcatggttcgtttaaaaaattagatatttaagttaattgcatcatcaataaagtattggtccatatcaaatgcaggtttcgcccctttatttttgcctactatttgagaaggcacaccagcgacagtagtgtattctgaaacggattgtaacactacggagtttgcaccaattttagcgtaacgcccaatttcgatatttcctaacactttagctccggacccaatcatcacaccttctcgaattttaggatgacgatcgccgctttctttgcccgttccccctaaagttacaccttgcaaaatagatacatcattttcaatgacagatgtttctcctatcacaatacctgtggcatgatcgaacataatgccgcaaccgattcttgctgcgggatggatatctacatcaaaggcaacggatatttggttttgtaaatagatcgccaatgcttttcgtccttgttgccataaataatgggtaatacgataactttgcaatgcgtggaagcctttcaaataaagtaacggtgtagagtattgttctacggcaggatctcgatgacgcacggctcggatatcgcaagccgcactttcgataatttgcggttgattttgatgtgcttcttcaataatttctcgcaatgcaatagcgggcataattggattagctaatttgttcgcaagaatatagcttaatgcactgcctagattgttatgttttaagatagttgcatgaaagaaactggctagcattggttcattttcagcgagttttgctgcttcagcacgaataagactccatacttctattgacatgttactcccttttgcgttttcttcccaataaagtaatagccgcatcttcaggttttttaccacaaaatagtatttgatatacctgctcggtaatcggcatttctacaccctgttgctgggctaataaaaaggtttcttttgtattgtaaaaaccctctataaccggaccaagttcattgatagccgttgtacaatcaaaaccttgtcctaacattaatccaaaacgacggttacgagactggttatcggtacaagtaaggactaaatcccctaagccggatgttcccataaacgtattcggattcgcacctagagatatgcccaaacgactgatttcagcgattcctcgagtaattaatgctgcacgtgcattagcaccaaaccccataccatcagaaatccctgcagcaatagcaattacatttttaaccgcccctccaagttgtacaccaatcatatcttgattaacatagactcggaatttgctacaatgaattctttcttggaactctaaggcaaattgttcgttatttgaggctaatgtaatagctgccggcatgccggcagccaattctttagcaaaggtaggtcctgataagactgctaaaggataaccatatcctacatgctcttcaacaacttcttgtaataagcgtcctgtatttcgctccagtcctttcgttgcccaagcgatacgttgatccgatcttaagtgcggtttaatttgcatgataacgtcgccaaaaacatgacttggtacaacaattaataactctctggagtattgaatggcttgtgctaaattgtcttctacatataaagaatcaggaaagtgaatattaggtaaaaatgcttgattttttcgctcattacgtaagcgttgacaatgttgaggatgatgtccccataagtaggttggatagccattgcgagaaaaggcaatagctaaggctgttccataagcaccggcaccaattacggtgattggagttggagaaggactgttatcattcatattttttcttagaattttcggaattaatagaaatcttagggtgttattacaacaccctgagagattaatggacttctttcttttctttttcttcagcttttgactcctcttgtgtttgttgacgttgcatatactcaacaaataaggcatcaaaattgaccggtgctagatttaaagccgggaaagtgccacgattcactaaactggaaattaattctcgtgcataagggaataacatatttgggcattgagatgttaggcaatgtgctaattgtacatcttctaaaccgcttatagcaaagatgcctgcctgttttacttcacagataaaagcaacatcttcactgccttccattgtagtttcaacagagatattcaggcaaacttcataaagatcttctgctaaatgggttgtttctgtgcttaaattaaaatccagtttcggtttccattcttgttggaaaatgtgcggtagattaggtgcttcaaaagaaacatctttaacgtaaatacgttgaatttgtaaaacaacttctgttccttgttcttctgttactgcatcttgatttttttctgtcatttttcgatccttatttatgttttttgactaaaggtaaatttgccgcaatccagccactgataccatctttcagtgagtaaactcgactaaatccttgtttaactaataattctgctgatgcacctgcattcatacctgttgcacaaactaaaattacaggggtatctttatgttgttcaatttttcctaaattttgatttttaatctctgttggcaatacattgatactgttgataatatgaccacgttgaaattcatctattgtgcgtaaatcaataacaatagcctcttcattattaattaaacgagtcgcttcggcgttttctactgccgtaactttactggtaaatgattttaccgatgtataaattaacatgacaaatacggcaatccatgctattaccattaagctatgattttttgcaaactctgttgctaaagggagatattcttgcattttttctatttttcaaggttaaagttaaggttaaaaataaagggttaagtataaccgcactttcttcatctttcaaaatttttcaaaaaaagtcctgcaaataaattgatctatattatagatagcttccctgtttattggtatattagccccaaatttcaaggaagtcttgataactttgttgaaatagggtttccgattttatcggaaacgatttttaagtagaaaaaataggaaaaaaaatgttttatattcaattcgctatcgttttagtgtgtattctgattggtgcacgcattggtggtatcggtttgggcgttatgggtggtttagggctttgtattctcgccttcggcttcgggttacaacctgctggattaccgattgatgtgatgtttatgattatggctgtagtttctgccgctgctgcaatgcaggcagctggtggtttggattatatgatcaaaatcgcaaccaatattttacgcagaaatcctaaatatatcacttttgtcgcacctgccgtaacttggttatttactttcttagccggtactggccatgtagcttattctgtattaccggttatcgcagaagtaagtcgtcacagcggtattcgtcctgagcgtccactttcaatggcagtaattgcatcgcaatttgctattgtagcaagtcctatcgctgccgctgtagtggctgttgtgaactatttagaaccacaaggaatcaacttgggtagcgtcttaatggttactattccgtcaactattttaggcatagcacttgcttgtgtttttgtcaataaaatggggaaagaattaaaagacgatccgaattatcaacgtttattacaaaatcctgagtatgtcaaagaaaacagcgtaagtaatattgctgaaattgaaataaaaccgactgcgaaattatcagtgggcttattcttattcggtgcattacttgttgttgtgatgggagcgtatccggagttacgtccatcattcaacgataaacctatgggtatggctcacactattgagatcgttatgttaaccgttggtgcattgattatcttaacctgtaaaccgaatggtaacgcaattacacaaggttccgtattccatgctggtatgcgtgcggtgattgcaatttttggtattgcttggttgggagatacattgatgcaaggtcatattgcaggcattaaagaaagtgtgaagttattagttgaaaccgcaccttgggcatttgcatttgcactgttcttactttctgttttggtaaacagtcaaggggcgactgtagcaactttatttccgctaggtattgcattaggtattgaacctgcgattttaatcggggtatttgtagcagtaaacggttatttctttattccaaactatggtccaattattgcttcaattgactttgatacaacaggcacaacaagaattggtaagtttatctttaatcacagctttatgcttccaggtttattaagtatggcatttagcttaggtttcgggttattgtttgcaagtattttactttagttttcactaaataatttataaaaacaccgcacttgctttaagaagtgcggtgttttttgagattttgattttttaaataccgaataaaacagcaatgaaaacggtcaagccgaaataattgttatttaaaaaagcgttaaagcaactcgctctatctctatttttagtcaaacggcattggtaaacgaaaaataagccggcaatagccaatacaataaaatatctgttatttaattgtgataaataacccacggaaaagagaaaaatcagcgttattatttgtaataatgcgatgattttattgtcatattgagcaaataaaatcgccgttgatttcacgccaatacgcaaatcatcatcacgatctaccatggcatattgagtatcatatgcgactgtccaagataaatttgcaataaataataaccagcattctagaggcaatgcttcaatagtcgcaccataagccattggaatagaccagccaaaagccgcccctaagaaaaattgtggcaaatgtgtataacgtttcataaagggataaataaatgccaaaatgactgcaatcacagataaaccaatagtataaaggtttaaacaaaggactaataaaaaagaacaaaaaacgaggacgataaataaccattttgcttcacgaggtgttgctcgacctgttgaaagtgggcgtagtgaagttcgtttaacttttccgtcaatatggcgatctgcataatcattgatgacacaacctgctgaacgcattaaaaatacgccgcatataaaaattgctaaaactgatagggtaggcatcgctttttcggcaagatataatgcccaaagcgttggccaaagtaaaagcaatgtgccgataggtttgtctaaacgcattaattgtccataagcaatcaacttatcttttgcaaatattgtcatttgattggctaaaccttgtaattcttaataaaagtgcggtgtattttactgtaaaatcctttttggaaaaagtgagtttaccctataaagaaacagtgttatattgcgaaatacttttattgttaaactatcataaaatgactacattcaaagaaatcaactctgaacaagcatgggaaatattaaataataagaatgctgtattagtagacattcgtgatttatcccattttatttacagtcgtccgcaaagtgcttttcatttaactcatcagcgttttagtgaattccaacagaaatatgaatacgaccaaccgattattgtgagttgttatcatggtgtgagtagccgcaatgtggcacaatttttagttgagcaaggctatgatgaagtttatagcttaattggaggtttcgccggttgggtacaagcgaatttaccggtggaaagtggatattaaataaaaggcagatcatttctgccttagttcagtccaaccgcacaaacatagatcaaaacactataaaaaatcgccgcacttagtagcaaaacatattttgccagcttactgttacgttgatttaatttaaatgaataacgagcaataatgcctaaaataaaaggataagcccaaaagaaaattgacatccatctcatttgaaaatcatccaaatttggatttttaatgaaattaggtgagattaagatagctaatggccaaagcaaaacaggtaggcaaaacccaacgagtgcccaagaaaatctactaaatccggttggcatgttttgttttttcatttttatcctcgataatatatacaagagaacaggaatatagcaaatgaaactattatttggtagtgaaagagagaattttattatttggtttcgtgattatatccgagctaagtatttgcttgaattgaccattcaaaactatattgatgaaaaatataatcggtcggtgcgtggtgtttttatcgaagaaaatcatccattattgacacagcttgaacaagagaaaatactttttctgcaggatccttttaacccttgttatcagcaggcagcttgggaagccggcgatacacattccattcagtacaaaaaaacatcatgggtggctatttggaaaatctcatcgaaatggttccaacaaggtaaaataactttatttattaccgcactttgcactctaatttacgttttacagaacttgggatttgagcaaggtattttctattttgctcattatccagcaaatccggcacaacaaacagaaatttggcgttatatttcgcatagtttagtgcatctctcgccactacattttttatttaatctaagttggttttggttatttggcggggcaattgaacgacagctgaatgcaaaaaaattactgttgctcttttttgtttcatctattttgaccggagtcgtgcaaaattatttctctgattatcgtttcttcgggttatctggtgtagtttatgcggtattgggttatgtatttattttagataaatttcattatgctaaatttgctttaccatcaggttttttcttgatgttaattatggggatcgccttaggttttattagtccgcttgtaggtatttatatgggcaacagtgctcatattagtggtttattatgtgggattttattaggcttatggcaagttaaaaaaagggagttttgagaactaaacgtaacatattgaaatcaatgaaatgtgtattgtcttatttctatgctctttcaaactcaagataaaatagatcgaaatttggaggatagagataaacgctgtcttgaagagaaatttattttgccattatggttattcttaattttcgcataaaatttgataatttcctttgactaattgacaatcaaaaggtaatattcacgccctatgcaaaaggtaaaactacccctaactgttgacccgattaaagatgcacagcgtagattggattatcaaggttgttatgtgtccaatcaagttactcgtttagcggagtcagtagtcaaagtgctcagcgatgtgcaggtaacattatcgtttttcgttgatccgcaaaaattgactgtaatgaaaggaagagcgagtgttgatgtggaattagaatgtcaacgttgtggttgtcctttcagtcaatcattggaatgtgagttttcttatagtccagtgtctgatttgggtaagatcaatgaattgccagagatttatgaaccgatagaattaaatgaattcggggaaatagatttaattggaacggttgaagatgaactgattgttgctcttccaattgttccgatgcattcatctgaacactgtgaagtgtccgtggctgaacaggtttttggcgaattgccggaagagctggcaaaaaaaccgaacccgttcgctgtattagctagtttaaagaaaaagtaaatttaggagtatagccaatggctgttcaacaaaataaaaaatctcgttcacgtcgtgatatgcgtcgttcacatgatgcgttaaccacagccgctgtatcggttgacaaaacaagcggagaaactcatttacgccaccatgtaaccgcagatggttattatcgtggtcgtaaagtgatcaataaataatcgttgattgtttaaggtaatcacttgagtcatctaactgttgtgttagatatgatgggcggggacatgagtccccgtattactatctgcgaattggtaaaagcgttgggtaagcatccaatgctgtctttgttgtttgctaataaccaacaaaattttcctctacgtcaacgttttccaatcgatagtcaaaattatttagccgtctgtcattgctctcatgtgattgaaaataatcagggtttagttcataccttagttcacatttttgtagaataccagctaggtttattttatctatatgcagctttgttaaatataggtattgaggaaaccaaagaatataaagaatataaagctattcgagatatggcattacaatcttcaaagaaaggttaaagaaaatcttgccggtttgaataaaattaagacgtaacttgatgagataattatgtacagtagaattttagcaaccggtagttatataccggctaatatcaggactaatgctgatttagaaaaaatggtagagacatctgatgaatggattactactcgttccggtataaaagagcgtcgtatcgccggtgaaaatgaaacagttgccacaatgggatttgaggccgctaaaaatgcacttcagttagccaatatttgccctaacgatatcgatttggttttggttgcgactaccagccactcctatgcttatccaagtgctgcatgccaaattcaaggtatgttggacattgatgatgcaatttctttcgatttggcggcagcttgcacggggtttatctatgctttaagtgttgcagatcaattcattaaaacaggtaaagtaaaaaaagctttagtgattggtgcagatattaattctcgtaagttagatgaaacggatcgtagcactattattttatttggtgacggtgctggtgccgtgatcttggaaagcagcgatattgaagggattatttctactcatttacatgcttctttagataaaagtaacgccttaattcttcctcaaactcaacatggtgaagcacaatccggttatattcaaatgcaagggaatgcaacttttaaacttgcagtacgagaattatctaatgtagtagaagaaactttacgtgataatcacttagacaaagctgatttagattggttggtacctcatcaagcaaacttacgtattatcacggcaactgctgaaaaattgaatatgtctttagatcaagtggtaattactttagacaagtacggtaatacaagtgcggcgacagtacctgtggcattggatgaagctgtacgtgacgggcgtattaagcgtggtcaattattattattagaagcatttggtggcggttggacttggggttctgcgttggttcgtttctaaattttaacaaaaattgaatatacttatttagtaggaaataaaaatgaaaaaatttgcaatggttttccctggacaaggctcacaagcagtgggaatgctggctgaattggctgcagaatatccgattgttgaagaaacttttcagcaagcttcctccgttttgggttatgatttatggcagttagtgcaacaaggtcctgcagaagaattgaataaaacgtggcaaacacaacccgcacttttagctgcttccgtggcaatttatcgtgtatggcaacaaaaatatcctcacctaaaacctgaagtgatggcaggacatagtttaggtgaatattccgctttagtatgtgccggtgtaattgatttccaagatggaattaaattggtacaacttcgtggtaagttaatgcaacaagcagttccggaaggaacaggtgccatgtacgcaattataggtttagataatgaaagcattgttcaagcttgcaaagcgtctgaacaaggtgagattgtgtcagcggtaaactttaattcaccgggacaagtggtgattgcaggagcaaaagtcgcagtagaacgtgctgctgttgcttgtaaagaggcgggagcaaaacgtgcgttgccgttagcagtcagcgtgccttctcactgtgcattaatgaaaccagcagcagaagaattggcagtagcgttagaaaaaatgacgtttagcatcccacaaattccggttattaataatgttgatgtgaaagcagaaaatgaaaccactaagattcgtaccgcacttgtgcgtcagctttacagtcctgtacgttggactgaaatagttgagaatatggcaagagagggaattgaacttttatttgagatgggacctaataaggtgctcactggattaactagtcgtattgttaaagagttgaatgctaaagcagtcaatgatttatcttcattgaatacagtggaagaaagcttagattaatttatgacaacagaggctgatactaaacagcctattttattgaggagtagatgatgcaaggaaaaatagcattagtaacaggtgctacacgtgggattggacgtgcaatagcagaagaattagcgagcaagggggcttttgttattggtactgcaacaagcgaaaaaggagcggaaagtatttctgcttatttaggcaaacagggtaaaggtttggtattaaatgtcgcagatcaagattcaatagatgctgtattgagtgccattaaagctgaagtgggtgatgttgagattctagtgaataatgcaggaattacccgtgatggtttattaatgcgtatgaaagatgatgactggtttgatattatgcaaactaatttaacgtctatctatcgtttatctaaagctgtattacgtccgatgatgaaaaaaggtggacgcattattaatattggttcagtagttggctcaatgggaaatcccggtcaaactaactattgtgcggcaaaagcgggtgttattggctttacaaaatcgttagcaaaagaagttgcagcaagaggagtaactgtgaatgttgtagctccaggtttcattgcaacagatatgacggatgtgttaactgacgagcaaaaagcaaatattctgacaaatgtgccggcaggtcgtttgggacagccaaaagatattgcgaaagctgttgcatttttggcttcggaggatgcgtcatatattacaggtactacattacatgttaacggtggaatgtatttaccttagtagaaatagggatttcaggctggccaaagataaggcgtaatgttaaaatcctgacatgtggtaatgtagctattgaaacaatcgagttacgttggctgttgcattctacaggttaacataacgtatttatgtttgtgtactgagacaggtatcattgtggtttgaccttgtaaaagtaaaaacagcttgaaacttcataaaaaatacatacactattatatcttatcgctaaccattaataggaaaaaagcaaaatgagcattgaagaacgtgtaaaaaaaatcattgttgaacaattaggtgttaaagaagatgatgttaagcctgaagcttcatttattgaagatttaggtgcagattctttggatacagttgaattagtaatggctttagaggaagaatttgatattgaaattccggatgaagaagctgagaaaattacaacagttcaatcagcaattgattatgttcaaaataatcaatagtaatgatacttgaaaattacacatgaaatcagtataatccgtattcacttatgaccctttgagagggtcatatttttgtgtggcacattgtgcttgtatgaaatggggagctgaaacggcgttattacccgcaaagaggaaattaaaaatggcaaaaaaagtccaagcatacgttaagttgcaagtcgcagcaggtatggctaacccatcaccacctgttggtcctgcattaggtcaacaaggtgtgaacatcatggaattctgtaaagcatttaatgctcgtactgagagtctagagaaaggtttaccgattcctgtcgttattactgtttatgcagaccgctcttttacatttgtgactaaaactccgccggcagcggtattattgaaaaaagctgctggaattaaatctggttctagtaaacctaacaaagataaagtaggtaaagtcactttagatcaaatccgtcaaattgctgaaactaaagcagccgatatgaccggtgcaacaattgaaactaaaatgaaatctattgaaggtacagcacgttcaatgggtttagtagtggagggttaatctaatggctaaacttactaagcgtatgaaagcaatcaaagccggtgttgattcaacaaaacaatatgaaatcaatgaagctattacggtgttgaaacaattcacttcaacaaaattcgttgaaagcgttgacgttgcagtcaatttaggtattgatgcacgtaaatcagatcaaaatgtacgtggtgcaaccgtgttaccacatggtacaggtcgttcagtacgtgttgctgtgtttactcaaggtgctaatgttgatgcggctaaagcagctggtgctgatttagtaggaatggaagatttagcagagcaaatcaaaaagggtgaaatgaactttgatgttgttattgcttcccctgatgcaatgcgtgttgttggtcaactaggtcaaattttagggcctagaggcttaatgccaaaccctaaagttggtaccgttacaccaaacgttgctgaagcggttaaaaatgctaagtccggtcaaatccgttaccgcaatgataaaaacggtattattcatactacaatcggtaaagcaaatttctctgctgaacaattaaaagaaaacttgcaagcattattagctgccttgactaaggcgaagcctgcgacagcaaaaggtatctttattagaaaagtaagtgtttctactactcaaggtgcaggcgttgctgttgatcaaagtagcttataattaatgtagccaaacctttacagaggcgtattttgtatatataatgcacgcctctattttgccttatagcataatttctggttggtgcttgacctctcaagccccgtccaagaccgtaggggaaagaatatttcttaataatcctacgtagatggtgatacagaataagaatttttcttgcttctgtgcaccttagcctcagagaagactgcaaaagtgcggtgtttttttgagaagttttataattccgatcaatcggagtgtattcaggagctaaaagccaatggcattaaatcttcaagacaaacaagcaattgttgctgaagtaaatgaagcagccaaaggtgccctatcggcagttattgcggattctcgtggtgttactgttgataaaatgactgagttacgtaaagcagctcgtgaagctggcgtttctatgcgtgttgtacgtaatactttattacgtcgtgcagtagaaggcacagcttttgagtgcttaacagatacgtttgtaggtccaacacttatcgcattttctaatgagcatccaggtgcggctgcacgtttgttcaaggattttgctaaagctaacgataagtttgaaattaaaggtgcagcctttgaaggtaagatccaaaatgttgagttcttagcaacattaccgacttacgaagaagcaattgcacgtttaatgggtactatgaaagaagcagcggcaggcaaacttgctcgcactcttgcggcataccgcgacaaattacaagaagcggcttaattaaagcctttcttaactcgtttaatttatttactttaggaattgattgttatgtcattaactaacgaacaaatcattgaagcgattgcttcaaaaactgtcactgaaatcgtagaattaatttctgcaatggaagaaaaatttggtgtttctgctgcggcagcagcggtagcagtagctgctggtccagctgaagtagctgaagaaaaaaccgaattcgatgtggttttagctgaagctggtgctaataaagtagctgtaattaaagcagtacgtggtgcgactggtttaggcttaaaagaagctaaagacctagtagaatctgctccggctaacttaaaagaaggtatttctaaagcagaagctgaagcacttaagaaagaattagaagaagctggtgcgaaagtagaaatcaaataattttgattttttcaatcttctagttcagaaaagacttggtggacaccccaaggtcagaataataatcctaccttttcgtgctttttcgaaggtgggattattcttttttatgctgtcgaagagtttatttgtagatgatcgtaatttgggagaaaaactttacttttgtctgcagtgggttgagtgcggtttgttttaagccgcactttttcgtttcattcgcaatgagattttttattttaagaacgtttcataacttcaaaaaattcttcattggtttttgccatcattagcttatcaattaagaattccattgcctcaatttcacccattggattaagaattttacgtagaatccacattttttgtaattcatctggtgtagtcagaagatcttctttccttgtaccagaacgattgaagtcaatagcaggaaatacacgtttttctgcgattttacgggaaagatgcaactccatattcccagttcctttaaattcttcaaaaatcacttcgtccatttttgagccggtatccacaagtgcggtggcaataatggttaaactaccgccttcttcaacattacgggctgcaccaaagaagcgttttgggcgatgcaatgcattggcatctacaccccctgataagatttttccggaaggcggtgttaccgtattataagcacgagctaagcgagttatgctatctaataaaataaccacatcttttttatgttcaacggaacgttttgctttttcaatcaccatttctgcaacttgaacatggcgtgctgccggttcatcaaaggttgaagcaatgacttcgccttttactgagcgttgcatttctgttacttcttccggacgttcatcaatcaacaatacaattaattcacattccggatagttatgaataatactttgtgcaatattttgtaacaacatggttttacctgcttttggcggagcgacaattaaaccacgttgtcctttaccgataggggaggctaaatctaaaatacgagcagtcaaatcttccgttgaaccatttccacgctccattctgaggcgtgaatttgcgtgtagtggagttaagttttcaaagagaattttactacgtgatacttctggtttatcgtcattgactcgatcaacttttagtaaggcaaagtaacgctctccttcttttggtggacgaatttttccttcaattttgtcgcccgtttgcaggttgaaacgacgaatctggcttggagaaacgtatatgtcatcaggaccggctaagtaagaactatcggcagaacgtaagaaaccgaaaccatcaggtaaaatttctaatatacctcctccaaaaatgtcctctccacttttcgcatgttgttttaaaattgcaaaaataatgtcttgtttgcgtaaacgagctaaattttctaagcccatttgtttttcacctaattctacaagttcagaaacaggtttatttttaagttctgttaaatgcataataaataattgagaatgttataaaaatgaattgataaatgaattgaatataaatatgaaattgcgtgcaaatttatcattaaatctttaagttgtctagctatctaacttaaaaatcaataaatgtgcggacattttttgaggattttttccgttcatgttattatcacccaaattctttactgataatttttatgcaaaatagtcatctttcacaacaacgtttttctgatcttgctttacattgtagcgtgcaacaagcgataaaagaaaaaggctttgagttttgtacacctattcaggcattgtctttacctatcactttaaaagggcaagacatagctgggcaggctcaaaccggcacaggaaaaacgatcgcatttttaactgctacatttcatcatttgctacaaaaaaacaatataaattcctcagaacaaccgagagcgttaattttggcaccgactagagaattggttgtacaaattgcaaatgatgcgaattttctggttcaagcaacagggttgaaaactggcttagcttatggtggtgagggctatgataaacaattaaaggtaattgatcggggtattgatattttaattggcactacagggcgtgtaattgattatgttaagcaaggaattattcgtttagattatattcaagtggtagtgttagatgaagcagatcgaatgtttgatttaggttttattagagatattcgttatttattacgtaaatgtccggtgcctcaacaacgtttaaccatgcttttttctgcaactttgtcttataaggttcgtgaacttgcttttgaacatatgaatgatccacagtatgtagaaattgaacccttacaaaaaacggggcatagaattagagaggagttattttacccttctaatcaagataaaatggcattgttgatgactttattagaagaagaatggccagagcgttgcattattttttctaatactaaacatcgttgtgaggaaatatggggatatttaagtgcggatggtcatcgagtaggattattgaccggtgatgtaatgcagaaaaaacgcttatctttactcaaacaatttacggatggaaccttagatattttggtggcgacagatgtggcagcacgagggttacatattccggatgtgactcatgtgtttaattatgatttacctgatgattgtgaggattatgtacatcgtattggaagaacagggcgagcgggtgaaagcggtatttcaatcagttttgcttgtgaagaatatgcgattaatctgcctgcaattgaagaatatattggtcatagtattcctgtcagtcaatatgatgcgaaagcattgatcgaagatttgccaacacctcatcggattaaacgaggtgcatttgatagccgttcgaatttacaacgtactgtaaagagattgaaaaaaacttattaatttaaccgctcttttatgggagctttgccaagataagcaaatatccctttaattaccggacgataacgttgtacactaatacggaattttcgactaggaatagagagataaaaatgacaccttatttaattgctccatctatactttctgctaatttagcacgtcttggtgaagatgtagaaaatgtgctaaagagcggtgctgatgtaattcattttgatgtgatggataatcattatgtaccaaatttaacctttgggcctgcgatttgtaaggcattgcgtgattatggaattaaagcacctattgatgtacatttaatggttaaaccggtagatcgtattattcctgattttgctaaagccggtgctgattatattacatttcacccggaagccagtgaacatatcgatcgttctttgcaactgattcgggattgtggttgtaaggctggtcttgtttttaatccagcaacaccattgagttatttagattatgtattggataagattgatgtgattttgcttatgtctgtgaatcccggatttgggggacaagcttttattccaagcacattagaaaagttaaaacaggctcgtaaaattattgatgaaagtggcttggatattcgcttagaggtagacggtggagtaaaagtgaataatattgctgaaattgctcaagctggagccgatatgtttgtggcaggatctgcaatttttgatcagcctgattataaaaaagttattgatgaaatgcgtcagcaactttctacaataagagagaaggaaacaaaatgacacaatttaaattaattggttttgatttagatggtaccttagtaaacagtttgcctgatttagctttatcaattaactctgctttgaaagacgttaatttgccacaagcatcggaaaacttggtgatgacttggattggcaatggtgctgatgttttgagtcaacgtgcagtggattgggcttgtaaacaagctgaaaaagagttaacggaagatgagtttaaatattttaaacgtcaatttggcttttattatggcgaaaatctttgtaatatcagtcgattatatccaaatgtgaaagaaaccttagaagcattaaaagcacaaggctacattttagcagtcgtgacgaataaaccaactaaacatgttcagcctgttttaactgcttttgggatcgatcatttgtttagtgaaatgctggggggacaatctttaccggaaattaagcctcatccggcacctttctattatttatgtggcaagtttggtctgtatccgaaacaaattctttttgttggcgattcgcaaaatgatatttttgctgctcattctgcaggttgtgctgtggttgggttaacttatggttataactataacattccaattgcacaatcaaaacctgattggatctttgatgattttgctgatattttaaaaattacacaataaggataaaaaatgacaaaaccggttgtattaagtggtgttcagccctcaggtgaattaactattggtaactatttgggtgcgttgcgtcaatgggtaaacatgcaagatgagtatgagtgtttatattgtattgtagatttacatgcaattacagttcgccaagatccggacactttacgtaaagcaacgttagatgtattggctctttatttagcctgtggtattgatccaaagaaaagtacgatttttattcaatctcatatacctgaacatacccaattggcatggattttaaattgctacacttactttggtgaaatgagccgaatgactcaatttaaggataaatcggcacgtcatgctgacaatatcaatgtaggtttatttacctatcctgttttaatggcggcagatattttactttatcaagcaaatcaagtaccggttggtgaagatcaacgtcaacatttagaaattacacgtgatattgcacaacgttttaatgctctttatggggaacattttattgtgccagaagcatttattccaaaagcaggtgcacgagtaatgtccttgttggaacctgagaagaaaatgtctaaatcggatgaaaatcgtaataatgtcattggtttgttagaagatcccaaagcagttgtgaagaaaattaagcgagctgtaacagactcagatgaaccgcctgttgtgcgttatgatgtaaaaaataaagcaggtgtatctaatttattagatattttatccggtgtaacaggaaaatctattgtccaattggaagctgaatttgaagggaaaatgtacggacacttgaaaagtgcggtggcagatgaggttgctactatgctgactacattacaagaacgtttctatcatttccgtaacaatgaagaattattaaataaaattgcggctgaaggtgcagaaaaagcccgtaagcgtgcaaaggaaaccttagataaagtttatcgtgcaatgggttttgttactccataaaaacgatttttcccctaagtatttaggggatcttttttcttattgtaatacattttcgaaaaaaacagtatttgcagtagggtcacttaatgaaaatagtaagaactttccgaaaaaccgccgttattacaaaccacagaaatctgatactgcgtatagaataagagaaaaatcttctatggcaaaaaatagaaaagcaagcatttcccacgtgacattattagggtgttaaaatccaaggttgtgctaatgaaagagaataaatattagcgatgaaatgagattgttcttctttgggaacggggaagggaataaaggttaatagttcttggtgtaatttcaaaatttttgtaaaacagaccgctctttcgatctctgaaaaaaaatctgggtttaatgctttagccacatatcctctttttattctgcctagtgccatagctaaatgaatgagtaacatgtctacttgtttcgtttttaaatttactcgccattttttaccaagacgatttcggatattaagagtaattgtcataatatcttcatcaattaaatggcgttgaactaaaaaaatcagcctttgctgtattaacatgaatttcattccattatgaaaaggatagtttactttacctgaaataaacacaattaagtagtgcatagatcacaactttgtaggaaaataaacaaaattttacacgataggaattaagatgttaaacaaggaaattatcgcacgatatgaaggattaatttttgatatggatggcacagtaattgatactatgccttgtcataaacaagcttgggagcttgttggtgctgaaatgggctatgctttggatggagatgttatgtatcaattggggggagctccggtaagaactattgccaaagccataatggaaaaagcacaaatgccgttatatttaatggaagatgtgattagtttaaagcgtaaatatggaattgaattaatcatgaaaaatgctactttattgcctgctgcggatattgtgaaacaatatgttggacaaaagcctttagctctcggtacaggttcacatcgttacgtcacggaaatgcttttagagaaatttcaattgcagtcttattttggtgctattgtgacagcggaagacgtgattaatcacaaacctgagccggatacatttttgcgttgtgcagaattattaaatcttgatccgttaaaatgccttgtatttgaagatgcggatttgggcgtacaagccggattagcggcggaaatggatgtttttgacgttcgtgtaaatcaaataattacaagcaagtgattagattttatctgtattttgtgtaatctgaacatttaggcagggtagagaaatagttgccaaccttatttttcattatgtttgtagcttttatttaaaaaatactttatgaacataaagttgtgctttttttatccgttatgattatttaacgtttgctttaactctttaaaaagacccttggttctatttattgtcctttcaatatctaactcagaatatttctcgaaagtaaatagataattgtgatattgctttaaactagtataagctacttttattggcaaaacagttgtttattcatttttcaaaaataaagcttaaagccttgtgctataaggctttaagctggtttttagacaactattttgtctgctttagaatttataatttacatttaaaacaaatgtgcgtccttttgaatagttgtttaaggctttctggtatccatcgcccacgcccatagcataagtcatttggtttgccgagtcgttattcgcatctagcggattaatgtattttttatcaaaggcattttgaatttcgcctttaatagttaagttttccgttggttggtagatagtgtaaaaatcgaaaattattggctgtgctttgatttcttccgtgccgctaattcttacataagtaagaaatgtctcgccagtcttcctagaagtaaaagttcccggcaagataacatcgccatctgctttatcaagtctggctcgtttgcttttaccatagtatttagcagtaccgcctaatgttaattttccgtcaaataaacgtgttcctaggtcaagggaaccgtaatctttcggtagagacgatattttacttaagccgaacccttgtaaatattgtccggtttcactatcgtcccccacgctattactggaatcagaatatgaacttggctgattggttttttgtctggcataggataagttggcatagaaccaaccgatatcataatttaattcaagttccaacccctgaattttaacaataggtgatgaatcagcaggaatgagttggtttaaaggaacttttgtttttccatctcctgattctaccatttctgttttcaagattgttttgccaccttcatagttaatatgcgtaagatgcccaacgcagtcataaatagtcggtgctttatctgctcctctccacgcgtttgaactacattcttgtttgatattgataatataatctctgatttttgtttggtacgctaaaatcttaaagcctagtgcatcaaaatccgagaatatcccatttttataaccgttaatgccgaattgaatggttttggctttttctgattttaaatcgggtcttatggctaatgtaccaaattcggagaaatacatctctttgatattcgggacccgatgggttttggcataactcacaaatggcgaaaagagcgggtgaaaatccgccgagaaagacatagaataattatcatgagatcttgaatttcccttgtggacagagtagaaacttgggcagttataaacatcccaagcactatagtcatcactaaaaccagtataacaccccaatttttctgctccctcaacaccatacttcgcaactatctctgatgagttggaatttacccaaactggcaatccattcttcatttttttatgagagtcatgccatgtcatatatgaaaatctatccttaggatcaagagggaaaatcctaccttcatatttatagatttggcgattggcattgacttttaaggtataaatatcgtatttaaaggtttggtcaaaatagagggttttaaaacgttgttcgccgtcgggttggaacgtattcgatcttatgccgtgatatttacatgcgtttttatacttaccaacctcatcacaagcataaagtgaattaggttccccaccatcaaaataataacctaattcacgaggatgtcgatttttactgtatttatttttgaggatattggcacctaatgttgcttcataagagaatttttctgtgaatggaatagaaaaatgcatatttatatccgtggttttcgcactatttttgctttccaacacatctttcagctttttaccattaaacacgcttcccttgtgataggtttgcgtagaggtattatccgccaagattaattcaaattgtaaattctctttcggttttagttggtagtttaactggtagtttttattctctaaatttctgccggaaagtgcggtcgataaagagcggtatgacaggatagctttattatatttatcgttatattcgattttggctaaatggctttggggatagtggagtaatttgcttgggtcatagggttgtaatccatagagttttcgtttttcatttctgtcacaaaaaggctcacctttacaagcttctttaactattcttcccacttcttcagcgtcaacatcttttatacttctacccccccccactttaaaatcttgcgagcttttacgccaactataggcatacataaaacctaatgttcttgtatcggaaaaaggatagcgaaaggcaaccgcacccatataattcggtccggttgcattggttcctccgccaacatttaataaagcacctacatttctgccttcacttatcacatcatcaacaccaattgttctaaaatttgccgaacctactagagcattagcccccgctttaccgtcaaaacttcctcgttgaatatctacactggtaataaacgcagggtcaatggttgcaccgaattgagaggttccaccggctttttcgctgttatctcctgatgtggcaaaaaaggtttgcgaaataccgtctaccatcgtattcacacgaccgaatcctgtttgacctcgaacgttcaccgacactgtccccgaactcttatcaaggttggtaaacgcacccggtaccgttctgatgatgtcatcaatagactgcgttgacgtggaaatattttctctcacactggtcgctcccgcttttttaaagacttcctgtttaggtggtagcttatattctacgttaatttgatcgagcatttcttctgcataaacacaagtgcttaatacggaaaaagctaccgcagtgagtttaaatttattagtcatcatttttatcctagttatttatgattaaattcatggtgtaaacatgtacgaccagttatataaaaatatcctgtgtatgtcaattaatgataataatttttattattatttttagtttatgcggaaattcagcatgttatcaaaattgatattcgccagcctgaaagccagagtttggctctggcggaaaacatgctttagttaaaaatgattcggaggaaatgcggtctattttttacaaagatttatctttaataaaaggaaactgaatgcgatattttatcgccagcattctgatgagtgtacaggttataattgccagccatggacttagcaaaggggaaattaaaccggttgaacccaataattctattgtcgcaccgacaattgccgcactggcatatatttcagattgaaaaattaacggcggttttgccgtcaatatgtctcggatacaaccaccgcccactgcactgatacagcccaaaataatggataattgaatattttccgttagataccatgttttatttgcaccgaaagctgcaaaaaaacctaatccaacggcatcaagtaagttgctcacctttgagaacgacgttattttttcttgaaaaaaagatacgcaacacacggctaaaaggataattaatagataggcgatattttccaagcctgccggcggtgttgctgataggcataaatctcgaataattccaccgcctatcgctgttactgctgagacaacaaaaacaccaaataaatcaaattgtttcttcacgccagcaaccgcaccacttaaggcaaagataaatgtaccgagaagatcaatgaaattaaatacggataacataaaataccttaatcttaattttaaggcatcattctagcataacgaaattaaaaaaaaacttcgcagatgtaatggacacaaaaggattctatacattaatgaagcaaagtgtacatttgtacattacatcagcatagttgttatggtaatctagaagaacaaagtgtgttgaaaaaagagattcttggcgtaatgccgattttaatatttaaacgaaatatcctaagttatggtgaagaatatgataagtaatttaaccgaacagccttctggtgctgagtaccttaaagcaattttaagttcaaaaatttacgaacttgcacaggttacacccttacaacctatgctcaaactttctgagcgtttaagtaataccgttttagttaaacgtgaagatcgccaattagttcatagctttaaattgcgtggtgcttatgccatgattgccggtcttagccaaccgcaaaaaaatgccggtgtgattaccgcttccgcaggaaatcatgctcaaggtgtcgcactgtcagcgaaaaatctgggattaaacgcattgattgttatgccgcaaaataccccccgcattaaagtagatgcagtgcgtggttatggtggcgaagtgcttttatatggtgcaaactttgatgaggcaaaagcaaaagcgatagagctttctgaaagtaaaagtatgacatttattccgccttttgatcacccggcagttattgcaggtcaaggttctttagccatggaattattgcagcaaaacagtcatattgatcgtatttttgttcctgttggcggcggcggattagcagctggcgtggctgttttaattaaacaattaatgcctgacattaaagtgattgcggtagaaagtaaagattcagcttgtttacacgctgctttgaaagttggccaaccagtagatttagagcgtgtcggtttatttgctgacggtgtggcggtaaaacgtatcggcaatgaaactttccgtgtatgtcagcagtatattgatgatgttgtgcttgttgacagcgatgaagtttgtgcggcaatgaaagatatgtttgaaaatgtgcgggctattgcagaaccgtcaggggcggtgtcattagccggcttaaaaaaatatgtcaaagaacataatattcaaggcgaaaccttggttaatattttgtccggtgcaaatttaaattttcatacattacgttatgtttccgaacgctgtgaaatcggtgaaaaacacgaagcaatttttgctgtaactatccctgaagaaaaaggtagtttcctacgtttttgccatctgttaggtgatcgccctgttaccgaatttaactatcgttatgctgataaagaacaagcctgtatttttgttggtgttcgtattagtagtgaaaaagaaaaattagaaattattcaacaacttgaacaaaatgattataaagttatggatctctctgatgatgaaatagcgaaaacccatattcgctatatgattggaggacgaacaaccagcaatagcaaagagcggttatatagcttcgagtttcccgagcaaaaaggcgcattattaaaattcttgatgatgttaggtacgcattggaatatttctcttttccattatcgtgcttatggtgcagactatggtaacgttttggcaggctttcagttagatgagcatgatgaaattcgtttcaacggtcatttagaagaacttgcttatacttatcaagatgtaacggatagcccagcttacaaatatttcttagcttgannnnngatgaaatcaaaaaatgccatattaaatggcattttttctactcaactttgttaattcgcaactctttcggcacttcaaaaacggtattttcttcgcaaccctcaagctcttccacttcatcaacacctaattcttttaaacgggaaatcaccgattgaaccaatatttccggagctgaagcaccggctgttaagccaataactttcacattatttaaccaactcacctcaatatcatttgcatcatcaattaattttgcagtaactcccattcttgaagcaagttcagctaatctattggaatttgatgagtttttagaaccgaccacaataactaaatcggacaattcggctaattcacgaacggcttgttgtcgattggttgtcgcatagcaaatatcatttttgcgaggaccttgaatggccggatatttttgttttagtacctcaatgacatcggcagtatcatcaattgataatgtggtttgtgtcataaacgtgatgtcttcatcattccgtaaagtcagtttggcaatatcttccacatcttctactaaataaataccgcccttatcgttatcatattgtcccattgtgccaataacttcggggtgtccttcatgcccaatgagaatggcttttgttcctttacggctggcacgagcaacttgcatatgcacctttgtcactaaaggacaagtggcatcaaatacttttaaattccgctctttggcctcttgacgaacagcttgcgaaacgccatgtgcagaaaaaattacaatagcaccgttaggcacttcgtctaattcttctacaaaaattgccccacgatcacgcaatccatccacaacaaaacgattatgtacaacctcatgacgcacataaataggtgctccgtgaatttctaatgccagctccacaatactaatagctcgatcaacaccggcacaaaaaccacgaggattagccaaaatgattttcattagttctgcttgctctcttttttatcgttttgcttaaaagcatcaatagccaataatccggcaccaatacaaattgcaacatcagcgatattaaatacggggtaatgccattgtttccaataaaaatcaaaaaaatctaccacaaagccatgataagctctatcggctgcgtttgccaaagctccaccaaccattaacgcatagcctgtattttgtagtttctgtgttgcttgatttttatataagaaaaataaaatcatgaaggaaacgactaaagccaataaaataaaaaagtatttttgccaacctgcatggtcagccaaaaagctaaaggctgccccgtgattacgcacgtaagttaaattaaagaaaggcaatatattaatactttcgtataaagaaaaattttttactacagcgagttttgttattaaatcagtaaaaaaagcaaccgcacttatccaaagaaatggaagtcctgtttttgataaattcatatggtttccaatagatgaaaaacgggcgtaatataacacccaatttaaattatcttgcgattaaacgctcgtgcgttctgtttcgcaggatctactttgatagccgttattgtaaaatcttaaacatctctctaacggcggaaggattatatcttactttataccttatatccacgctctgaaagacggagatttacggcacgttgcgataaaattaaattctatgtgagtttagttcgattattctgttgtattttaaccgctcttttccagcaaaattgaataaattagaggataaaatttatttacttatattgccattgtttggaattttctctagaatttgagaaattttaaccccaaaacagataggtaatacaaaaatgaagaaaaaaatcacttttactaaatctctcatcgcttcagcgttggcattatcagcgagttatgtcaatgcgtctgctttccaactcgccgaggtatccagttccggtttggggcgtgcttatgcaggtgaagcggcaattgctgataatgccgccgttgtagcaaccaaccctgcattaatgagtttgtttaaagcgaaacaattctcatggggggggggtatacgttgattccaacattaatgtaaacggaaaaatagacgttagcacatcaccaattccttcttctcctgatattctaaatgttaaagccaatcaaaaaaatatcgtcccgaatacctttattcccaatctgtattttgtaacccctattaatgataaatttgccatcggtgcaggcatgaatatgaactttagtttgagaactaaatataaagatgattatgttggcggtgttttgggtggaacaagcgagatggattctattaatttgaatttaagcggttcatatcgtgtcagcaaaggattaagcgttggtgcaggattaaatgccatttatgccaaagcgaaatttgaacgccgtgcagggattttaaagaaaactattgatagtttacgtagtgatgacaatgagctgcttattttactctctccatcaatagtatcatcggcatatagcctaacatttcatgaaaacagtactgtagcacgcttacaagataacaatgcatggggattgggttggaatatcggtgcggtttatgaatttaatcaagataatcgtatcggtattgcctaccattctaaagtagatattgattttaaagataatgatacattgggttatatacttggcaaagaagagattaagcttcatcgtgcaaaaggtaagttaactttacatttaccgagctatttcgaaatttccggtttccaccaattaacagcaaaatttgctatgcactacagctataaatatacgcaatggagccgtttacaaagtttgcatgccgcttattccaatggtgaagtcgcttttcataaagatgaaaactttcatgacagttctcgtgtagctttaggggcaacttatgatgtgaatgataaattaactttacgtgcaggtattgcttatgatgaatccgccgaccacccaactgcttccattccggataccgaccgcacttggtacagcttaggggcaacctatcatttcacaccaaatctttctgtcgacatgggctttgctcatttacgcggtaaaaaacagaaatttaaagagaaccactcatttacaagcaaagataattatgaagtaggtagaatagatgcagattatcaatcaacagcacgagccaatctgtatggcttaaatcttaactaccgtttctaacgattatccaattgtttattagttatagaaggcgtattttgatacgcctttttattttttactcaaaacatcataaaatcttaaatgagtaatctaataaatatgtcaagttgcgattttaggaaaatgtcagtattcaatatcaatcaggcaaattgacgttgctctccgttaccttctacgttttcgatacaacgcccgcaaatgtgagaatgttccttatttgatccgatgtctgtagaaaagtgccagcaacgagggcatttttccccatcggcacgttccacttttatcgctaagcctgtcaattcgctttcagctacatcggctttcgacaacggtttcactacgacttgtgaggtaatcaacacaaagcgtaactcattaccgagttgttccagtaatggacgaatttcctcgcttgcatagacggtgactttagcttcaagtcctgctccaattaatttgtcgttacgtgcttgttctaatacacggttcacttcggcacgtacttttaataactgttgccagtaagtatcgtccaatttatcgctttcatctagcccaaacaaaccatcataaaattcctcggtaaagacgaattcagcacgattatccagttttggcaagtagccccaaatttcatcagcagtaaaagataaaatcggtgcaatccaacgcacaagagcttctgaaatatgccataatgccgtttggcaactgcgacgagcaaggctatccgccttagttgtatactggcgatctttgataatatccaaataaaatgatcccatctcaattgaacaaaaacgcattaagcgttgtacaactgtgtggaattgatagttatcataagcttctttgatttcgttttgtgcttctaaagcacaacttactgcccagcgatcaagagaaatcatttcttcagggttaactaggtcgttttttggatcaaatccgtttagatttgctagtaaaaaacgagcagtgttacggatacggcggtaagtgtcgcctgcactgtttaagattttgtgtgaaacggcaatttctcctgtgtaatcagtggacgctacccataaacgtaaaatatccgccccgtttttgttccaaacttcacttggcacaataacattaccgagagatttggacattttccgacctttttcatccaccgtaaaaccatgggtaagtacttgcttataaggtgccttattgttagttgcagtagataacatcaacgaagacataaaccagccacgatgttggtctgacccttctaaatacatatccgtagatttaccgttaaattcagggcgttgctctaccacggaagcataagttgatcccgagtcaaaccacacgtcaagcgtatccggcactttatgataagtttttgcctcttcacccagtaattccgcaggatcgagatcccaccaagcttgaatacctgctttttcaacacgttttgctatgtcttcaagtaattctaacgtgcgagggtgtaactcttccgtttcattatgtacgaacatagtcatcggtaccccccaagtacgttggcgagaaatacaccagtccggacggtttgctaccattttatcaatgcgagcttccccccaacttggaatccaacgcacagatttaatttcgcttaatgcttttatacgcaaatcttgcgtttccataccgataaaccattgtggtgtagcccggaaaataatgggtgttttgtgtcgccagcagtgtggatagctatgtttaatacgttccaatttaagcaatgcacccgtttctttcaatttttccaataccaaatcattggcttcaaatacgcctttaccggcaaagaatggcgttgaagaaatgaatttaccgtcatttgccaccaacccagccatttccaaaccatatttttttgataccacaaagtcatcttgaccgtgatccggagcggtatgaactaaacctgtacccccatcaacggtaacgtgatcgcctagaatcatagggacagaaaaatcgtagaatgggtgattaaagcggataagttctaaatcgccaccttttgccgaacctaaaatttgtatctgctcaattcctaacgcattttgtaccgtttgcactaattctgtcgccaagatgacacgctcgttaccaagttgaacaagctgatattccaattctgcattcactgcaatcgcacggttagacggtaatgtccaaggtgttgtcgtccaaatgatcgcagacaatgctccttgacctttaccaagtgcattgaatttttcttcaacctccgccgcacttaccgccgcaaaacgcacatagattgatggcgaaactttgtcttcatattccacttccgcttcagccagtgatgaagcacaatctaagcaccaatgaacaggttttgaacctttgtaaaggtgaccattttgaatcactttacctaaagtgcggataatttctgcttcagtttcaaaattcattgtaagataaggattatcccaatctcccagtacgcccatacggataaagtccgctttttgaccttcaacttgttcttttgcataatcacgacaagcctgacgaaactctgctgctgaaattttctcgttcggcttacctaccaaaccttctacttttaactcaatcggtaaaccatgacaatcccaacccggcacataaggtgtatcaaagccaagtgcggtcttagatttcataataatgtctttcaaaattttattgacggcatgaccaaggtgaagtgtaccgtttgcataaggaggtccgtcgtgcaaaataaaggttttcttacctttagaggcttctcgcactttttggtataaatttttatcataccagttcttcaacatatctggctcacgtttagccagatcacctcgcattggaaaacccgtttcagggagatttagagtgtttttgtagtctgtcatattaattatttctcaactttataatgaatccaagattgttttcgcactggaatacacaaggataacccattgatttaccgaatttaccaaacgaatttgtccattcagaaattcaaccatccaataatcatcaaaattaatatctgtagtattaatattgcattcttcatttgaccgagcataatctgcaccgcatactacttttgtcggcggaccatacttttggggcaatccatttaaaatatctttcacttcttgtacttcacgtgggaagggcggtctgttttggctataattcaaaatgtcaattgcaatactgttcaatacttgtccattaaaataagcggttgcctctcgattattgccgttaaataaaaaatgctgacatttataagaatttaatggctggtaatattcccaaccggtgcataatttagagtcggcaatttgttgataggtcatgccgaatttaagatctttataaccgtctaaaatgatattttgggcaaaactcaagcagggaataaatgtacccgaaatcagcaacaaattttttaactttttcatgaaatgtcctaacagaatttcttgcattaacataatttatttgcaacaagaaaataagcaaaagcgatttagcattatacgcataaatccttaacggtcaaaggttcaagacttgctgaaaatacttttttgccacaacaacatcattttcaatctgatttttaagggcatttagagaaggaaattttttttcatggcgaattttatggcaaaattcaatttgcaaggattgaccatacaaatcacgatcaaagttaaacaaatgcacttccaataattgttttacgccattgatagtaggtcgcttgccaatgttggcaactccttgaaaaatatcgccattttttaaccgcacttttacaacgtatacacctttaattggattaacttgccgatgtaaataaatgtttgcagtgggaaaaccaatagttcgtcctaatttattgccatgagcaactcgtccataaatacgatatggcttacccagtaacttttctgccaacgctaaattatcttctgataaggcttggcgaatggcggtgctactaatacgctggtcatttaattgtaaacttcgattatcttccactataaagctttgttgttgcccttttttttgcagaagtcgaaagtcgccttctcgatttaaaccaaaccgaaagtcatcaccaatgcttaaaaacttcatcttcagatgtttcactaaacaatctgaaataaattgctccgcacttaattgggcaaaagtgcggttgaatttaacgcagaaaacataatctacacctaactgtgccaaataggcgagtttatctcgtaaacgcataagccttgccggtgcctgatcaccttgaaaatactcataaggttgaggttcaaataacatcactacaacgggcaaattcagttgttttgctttcgcttttaaatgttgcaaaatagattgatgccctaaatgaacaccatcaaaattaccaatagttacagcacaaccctgctgttttaaaggctcgggtaaattatgaaaaccacgaataagttgcataacatcgcctaaaaataaaaatttcttgaaaattgtcgcacattatacgtataaatatacaatggtaaaagaatgcagcataagcttactttctgtttaaaattagaaaacgacaagcataaggatttttctcatctgccggacgttgttgctcaaattcaatctgccattcttgccaattaaattcaggaaagaaagtatctccctcaagttctgtttgaatttccgttaaatataatttatttgcttgaggaaggtattgcttaaataattcgcccccgccaatcaacataatttcatgatgattttctcgcacaaaatctaccgcactttgtagattgtctttccaaataatgccatcgtgttcataaggcgaacgagaaagtacaatattggtcctattcggtaagggacgaccgatactttcaaaggtttttcgccccataatgatgggttttccgccagtattttgacgaaaccaagcaagatcagccggcaaatgccaaggcatttgattatttttgccaatcacatgattttttgtcatagcaacaattatacttagtttcatttactttccttcttccttatcaaaaatcaaaaaagtttatcagcgagagtgactatactacaggtttgtgtcgataaaacaataagccgggtaatgctaggccaaaaacaagtgctccaatgaggaaacctgttttgagaaaatattccgtcatttgtgctacacgttgttcattgaaaccataatgatgcaaatgaacaattgcgatcatggctttataagcgaaaacgcctgggatcattggaataaccgctgcgacagtaaaaactttcgggtgagccaaataacgatgcgataaatatacgccaataaacccaaccacactggcagctataaaagtcgcaaaaactaaaggaatatcgaaatgtactaagaaagttcttgtcccatgccccaatgcccccaaaaatgcacaatattttaaaacattcttaggtacattaaacactaaagcaaatccgacggcaggaatagctgcaaaaaacatatcatctaataactttaagataaggtccatgattaacgcccccaattggcaatatgtaaaaaacttagtgcaaatacaattcctaaacaagtaccaaaagttaatactgttgccaaagtccaacgtgcaattcccatattaatatgtccttttagaacatcggcaagcgaattaatcaatggaaaccccggtaccaataacaatacacttgatgctaaggctatttgcggatcattacctaattcatatttaacagccaaacccgccaccatagaggcaacaaaagcggttatagcaaaaacaatcaaaggattataatgacgcaaagttaaagtttgacgaataaacatagcgatagatgaggcgataaatgtgattaaaaaaacgattatatctccaccagataaatgggcaaagcaagcacaggacaatccgatcatagtaacaactacaaaacgattgtattttaaaggcttaataccatctaattttttgcgaatctgttgcagatcatatagtcctttttctgccataattaccaagcgttgtacctctgttaccacttgcatattaatgcctttatcaaggtttttgcgtaccgtagtaatgcaattgtgatcatataatgtagtaataatgacggcattaggtgtcagtgcacattccacactatctattcccaatgcaaaacctaaacgttgtgccatttgtacaatcaatgtactttctgcaccatgctgtaataacatctgtgcaacttgtgcacaagttcttgttatttctcgttgtcgaaatgagctattatcctctgtagtattcataaaaacacctcattctattaaaaaagatgaccgcacttattatatgcctttcttctgtatcaattttgttttaaatcataaaacagcaatgaaaatcgcatgatttttcctaactttaatggtaacttatggggaaatttttcaggtaaagacaactatggaaacacaaaaaacaaataaaactattgtggtaaaatttggtaccagcaccttaacgcaaggttcatcaaaattaaatcgccctcacatgatggaaattgtgcgtcaaatcacacagttgcatcgatcaggctttcgtataattattgttacctccggagcgatggcagcggggcgacattatctcaatcatccgcaacttcctccaacaattgcctcaaagcaattactagcagcagtaggacaaagtcaactcattcaaacgtgggaacaacttttcgctatttatgatattcatattgggcaaattctgttaactcgagcggacattgaagatcgtgaacgttttatgaacgcaagagatacgttacatgctttattagataaccgaattattccggtaattaatgaaaatgatgcggttgcaaccgctgaaattaaagtgggggataatgacaacctttctgcattagtggctattttggcacaagcagaacaactctacttgctaacagatcaacgtggattatttgatagtgatccaagaaaaaatcctcaagcaaaactgatttccatagtcgataaaattactgatcatatccgctctattgccggaggaagtgggacaacgttagggacgggaggaatgacaacaaaaattagtgctgctgacatagcgactcgttccggtgttgaaaccattattgcaccgggtaatcttgaaaatgtcattgtcaatttggcttatggaaaagacatcggcacaaaatttgttgtgcagacagatcgcttggaaagccgtaaacagtggatctttgctgcaccggttgcaggtatagtaactattgatgagggagcggaaagtgcggtattgattcagcataaatctctattacctgcaggtattatcagtgttgaaggatgtttttctcgtggtgaagttgttaaaatttgtggttcgaacggtaaaaaaattgctttgggcgtacctcgctataacagcgattctctcatacaaataaaaggaaaaaaatcgcaagatattgaacagatcctcggttatgaatatggttctgttgctattcatcgtgatgatatggtcgtttattaatcagaaagtttttatcctgataaaataacaaccagcttgtcaaaagaatgtgtttagactactaaatgaagagcaaagacttcatatacttttgaagtcatatatgaataaaaacccagcaaatgccgggtttggaaaagagatataaaattaaaagaatttaaccgtttgctttctcaacttgactgaattcgagttcaaccggagttgctcgaccaaagattaaaacagaaactttaagacgccctttgtcgtagtccacttcttcaaccgtaccattgaaatcggcaaacggcccttcagtaacacgaatttcttcaccgggttgaaactctttgcgatgacgaggtttatctgcggtttcttgtacacgattaagaatacgttcggcttctttttgtgaaataggtgccggtttatctggtgttccaccgataaatcccatcactcgtggaacactacgaactaactgccaagtatagtcattcatttccatttgaactaaaacataaccagggaaatatttacgctcacttttacgacgtttaccaccaacattttcaactacttcttctgttggaactaatacttcaccaaactgttcttccatttgatgtaatttaatatattctcgtaatgtcgcagcaacacgaccttcaaaaccggaaaatgcttgaaggacataccagcgttttttggctgtattttctgtcatattagaaccttaaatccgttaaaaatgtaattaatgaaacgataaccgaatccaatccccataaaattaatgatgctattacagtcacagcaaatacaattaatgttgtttgcattgcctcagggcgagtaggccatgtgattcgtctcagctcaatacgagaatcggaaaaaaatcttctggctttcataccttgattagtaatagcggcgatacctaaagcaataagtaaagcaacaacaatacccacaacacgaagagctgttgaaaatttttctactaagtaaatattacttacagccgccacaataacaatagcaaccactaacaaccataaaaagccattcagacctttcgatttctgctcaatttccggagctgctttattttttgtaatttctaatgccataaattagtccatcatttaattttatactggaatcctatttgaacgagcaattctagcactttcttattttattgcctatcaaaaaatataaattacgtgctatttttaatcttaatgaaaaagggatctataagatcccttttctgtcgaaacctatacaaataggaattcggtattacttaatgatcttagcaacaacacccgcacctacagtacgtccaccttcacgaatcgcaaaacgtaaaccttggtccatcgcaatcgggtgaattaagcttactgtcattttgatgttatcgccaggcatgaccatttcaacaccttccggtaattcaattgtaccggttacgtcagtagtacggaaatagaattgtggacggtaacctttgaagaatggagtatgacgtcctccttcctcttttgacaacacataaacttctgattcaaagtctgtgtgcggtgtaattgaacccggtttcgctaatacttgaccacgttcaatttcttcacgttttgttccacgtaataatgctccaatgttttctcccgcacgaccttcgtctaataatttacggaacatttctacacccgttaccgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagacgctaattcaagaattttttcttcccactcagcaactccatttaatgcttgtaatgctgaaccacgtacaattggtgtgtcatcgcccgggaagtcgtattgagaaagtaattcacgtacttccatctcaaccaattccaataattcttcgtcatctaccatgtcgcatttgtttaagaatacgatgatgtacggtacacctacctgacgacctaataagatgtgctcacgagtttgtggcattggaccgtctgttgccgctaccactaaaatagctccgtccatttgtgccgcacctgtaatcatattttttacatagtcagcrtgtcccggacagtcaacgtgtgcgtagtgacgtgtcgctgtatcatattcaacgtgtgaagtgttgatagtgataccacgtgctttctcttcyggtgcgttatcaatttggtcaaatgcacgtgcygcaccaccaaagtgtttggataatacagtcgtgattgctgctgttaaagttgttttaccgtggtcaacgtggccgattgtacccacgtttacgtgcggttttgtacgttcaaatttttctttagacattgagagtccctctaaaaaacacggttatcgatggtacaataacaccacattaacctaatgtatgatttacggtttaattaaaaggatagttgaaacaagaagtggtgctgataggcggatttgaaccgccgacctcacccttaccaagggtgcgctctaccaactgagctatatcagcgcctggagcgggcagcgggaatcgaacccgcatcatcagcttggaaggctgaggtaatagccattatacgatgcccgcagtccataattcaactgtcccatcagaattcattattaagaatggtggagggagaaggattcgaaccttcgaaggctgagccggcagatttacagtctgctccctttggccgctcgggaatccctccacgcaaaaatgaatacttgtttactttagaatggtgccgactaccggaatcgaactggtgacctactgattacaagtcagttgctctacctactgagctaagtcggcatcgtaagcaagtgaggcgtattatatggaaaaaattacccctgacaagtcttttttcgaaaaaaaaacactttttttattattcgattaataatcaggcaaaatatataaaaattgtgaaaaaaacagttgatttagtctctttccagatacttgttttagcatttataatgtatatttttatctctttctgtcattttaagtagaatttatcgtggaagaactcaacactattaaactttctgaccacttaacgccttttttaacttttaatcggcaacagtgggctgaattgcgaaaatcagtacctttgaaactaacagagcaggatttgaagccactattgggttttaatgaggagctttctttagaggaggtgagtacaatttacttacctcttgctcgtctgattaattactatatagaggaaaatttacgacggcagactgtcctcaaacgttttctcagcgggcataatcctaaagtaccttatatcattagtattgcaggtagtgtgtcggtgggtaaaagtacatcagcccgaattctacaatcgctattggccaattggcccgttgcaagaaaggtagacttaattaccactgatggatttttatatccactggaaatattacagaagaaaaatttgttgcaaaaaaaagggttccctatttcgtatgatactcagcgattaattcgttttttagctgatattaaatcgggtaaaaaaaatgttaaagcaccaatttattctcatttaacctacgacattatacccaaccaatttgatattgttgatcgtccggatattttaattttagaaggtcttaatgttttgcaaattgggtctaataaatcaaatcaaatgttcgtatctgattttgttgatttttcaatttttgttgatgcagaggaggatcaattaaaagaatggtatataaaacgctttctaaaattttgtcgcagtgcttttacagatccgaattcttactttaaacattatgccaacttatctgaacaggaagccatcgaaaccgcaagtcaaatttgggataatattaatggcttaaatttgaaacaaaatattttaccgacaagagaacgagcgaatttaatcctaaaaaaaggagaaaaccacaaagttgaattggtcaaacttaggaaataaataaaaaataccgcacttttttaaaaagtgcggtatttttatccgtattttaattaatgtaaaacatcaacaatatttaaaaagatgtttaatgctacgctatttaacagatcgataaagaatgcaccaaccataggcacaattaaaaacgctttgtgggacggtccgaaatgagaagtaactgcttgcatattcgcaacggctgttggtgtcgcccccaagccgaaaccacaatgccctgcacttaatacaacggcatcataatcacgtcccatcatgcgataagtcacaaaaatagaataggtagccattaccacaacctgtgctaacagtacgactaaaattggtaatgctaatccagccaattcccaaagttttaaagacatcaatgcgatagctaaaaatagtgataaacccactgtacctaacacatcaattgcctcatccgctactttgaacttcacaacatgagcgagtgcattacgaattaccgtaccggtaaataaacaccaaacaaacgtcggtaattgaagtgcggttccttttgtaagcacatctaaatattgcccggcaatcagacacacggacatcatcgtaatggtttcaataattgaacgagtattgattttgcggcgatatacgggcttttcaaatacctcttctatatcgtccacattttcatcttccggtacttccgctttatgcaagcgtttcaataagaatctggctaccggtccaccgataatccccccaaaaaccaaaccgaatgtcgcacaagccattgccagttccaatgccccttgaatgccaaaacgattacttaaagtttctgcccaagcagctcctgtaccatgaccacccgttaatgtaacggagcctgcgattaacccgtaagcaggatctaaaccaacaagcatagaggttccgataccgactgtattttgtagaataattaaaccaagtgcggcgaataaaaagataacgagaggtttaccgcctttcgctagacgagcaaagttggcacttagaccaattgagctaaagaacactaacatcattgtagtctgtaatttagtatcaaaactaaaactcatatcccaaaagtgatgcacaatgcttaagataatagccacaataaagccaccaaccaccggctccggaatattgtattcgctcaagaaatgtacacgtttcactaaaaaatagcccagtaataaaaccaaacaggctaatgccactgtttcataagtaccaaaagtcatattaacccctttttttgattgttgttcctgtatatattattaaatcagatactaggataggaaaaattagcaaaatatttttgcaaattcagcaagcctgtggaacgtaacaaaaaaaagcatttttgtctagcaaattacttctttatgtatcagtaaaagtaaaatttggtagatctatttagtcaaattcaagctcaaccgcattttctcctaacattgttaccagtgcactcaataactcatctgttggataaacagaccattgcacaccgaagcgtatcaaagctcgtccgtctttactttgatagtaaagatgtattggcaaagaaccgccgctacaaggttcaataattcctttgagttggcgaataaagtgcggtgttatttgctcttgggataagctgatggctaaattttttgcataacgactacgagcttcatctaaagtcattaactctcgtacagacatttttagcccttgagaaaaatcatcaaaactgactgtaccggaaacaataacaacggtgtccttctgtaatttatcaccaaaacgttctaaagcatcagcaaacaacgttatatctaaaagcccggaacggtcatctaaagttgcaatacctaatcggtttccttttttcgtcactgcaaatcttaatgctacaattaaaccgcaaacagtacttattttgcctcgagtgtttggagataactcatttaaacgtgtcgaactgtaatgagacaactcttttaaataacgagtaatcggatgactgcttaaatacaaacctaatgtttcacgctcaccgtctaaaatttgtttctcgctccaacgtggcgtgtgtgcataagcggtttcaacatcttcatggcttgaagttagtacaccaaacatatcaacctgtcctatcgcctcatcttttgcatgctgatccgatgctttcaacgcatcttccaaattttgagcaagtgcggctcgatgtggacccaatttatcaaacgcaccggatttaattagattttcaaaggtgcgacgattaatctgttttaaatctactctcgcacaaagatcgaataaatctttaaaaattccgccttgttcacgggctgaaactattgcatttattgggacttctccaacgccttttatcgcaccaataccataaacaatttcaccattatcattcacactaaaatgatgtttgcctgtattaatatcagggggaacaatagtgagacccatacgtaaacactcatcataaaagctcacgatcttgtctgtgttatccatctctgaggtcatcaccgctgccataaattcagcgggataatgtgtttttaaccaaagggtttgataagaaaccaaagcataagcggcagaatgagatttattaaaaccataaccggcgaatttttccactaagtcaaagattttcatggctaaatcgccatcaatcccttttgctattgcacctttttcaaaaatatctcgttgtgccgccatttcttcaggttttttcttacccatcgctctacgcaataaatccgcaccgccaaggctgtatcccgccagtacttgtgcaatttgcatgacttgttcttgataaacaataaccccataggtaggttctaaaatcggcttaagggattcatgttgatacttaacatcaggataagaaacaggttccactccgtgtttacgatcgataaagttttgcaccattccagactctaaaggaccggggcggaataatgctacaagtgcaataatatcctcaaaacagtcgggctgaagtttcttgataagatctttcattcccctcgactccagctggaagactgctgtggtttcagcttttttcaacaagttaaatgaatcgggatcatttaaaggaattgtcgaaatatctatcgcacttttaccctctttaactaaacgagcgttaatcatatccaatgcccatttaataatggtcagcgtgcgtaagcctaaaaagtcaaatttcactaatcctgcatattcaacatcatttttatcaaaatgtgtaacaggatgtttcccttccgagtcgcaatatagaggtgagaaatctgtaattaaactaggagaaataactacaccgcccgcatgtttacccgcattacgtgttactccctccaattttcttgccatatcaattaaggctttcacttcttcatcattgttataaatttcggataatctcggttctacctcaaaagcctttgtcaaggtcatacccggatcggcgggaattaatttagcaatacgatccacaaaaccataagggtgtcccaatacacgccccacatcacgaataaccgcttttgccgccattgttccaaatgtgatgatttgcgaaaccgctccacgcccataagtttctgcaacatgctcaatcacacgatctcgcttgtccatacagaaatccacatcaaaatccggcatagaaacacgttcaggattgagaaaacgctcaaaaagcaaatcaaattcaagaggatccaaatcggtaatttttaacgcataggcgactaaagaacctgctccggaaccacgtcctggtcctacaggaatatcattatcttttgaccactgaataaactccatcacgatcaaaaaataaccgggaaagcccattttattaatgacatccagttcggtttgtaagcgatcatcgtattctttacgtttttctgaccgcacttgcggatcaggaaacagggtctgcaaacgctcctctaatccctctttcgatttttggattaaaaaatcttccggacttaagtcacccgttggaaatttcggtaaaaaataagtccctaagcgaatagtgacattacaacgttgtgctattaatacagtattttcaagtgcggtaggaatatcagcaaacagctcacacatttcttgctccgagcggaaatattgttgtgaactgtataatttcgggcgtttcggatcatccagtgtataaccatcatggatagccactcggatttcatgtgcctcaaaatcctccggacttaaaaaacacacatcatttgttgctactaaaggtaattgtttttgctgtgcaagtattaaagcagattgaatatagcgatcttcatcggatcgaccggtgcgacttaaacttaaataaaagtggtcgggaaaatattcttgataaaaagctaccgcagtttccacatcagcagaattatttttcagtaattttttccctacatcgccattgcgaccaccggataaaatgataattccctcatgatgttctgccaaccaagactgatcaatgtaaggtaaattataataaccacgttcataagccttcgaaagtaataaggtaatattatgataaccctcgttatttttggctaataacgtcagttcaaaaagttcatctcccaacaaatcacttttcacgagaacatcagcaccgataataggcttaacgcctgaagattgtgcttcaccataaaaacgaactaagccacaaaagttagtaaaatcagtcaatgccattgccaccatttcatgttgcacacaggcttttatcaaaggttttaccttagtaatgccgttaatcatggaaaaatcactgtgtacacgcaaatgtacaaaacgaggctgtgacataaaaaatcctataaaaataatttgagggaaaaagtgcggtgtattttagcgatatttctcaacaagctcaatcaaaggcaaagggcaaaaattccagcaaattattaccgcactttgaaaaaaagaaacccgactaaaagccgggtttaatttagctaaaatgaactactgttttgcaacaaccttcccatcaacataatccacaatgacttttttacccggtaataattgtccggataagatttgttgtgctaatggattttcaatttcttgttgaatggcacgttttaatggtcttgcaccgtaaatcacatcgtagccaacttcaccgataaaatctaaagtcgcatcggtaaattcaagctgataaccatgagtttccatacgtttcactaagcgttgtaattgaatagtggcaatggcacgaatattttctttagctaatggatggaataccacagtttcatcaatacggttgatgaattcaggtcggaaatgttgccctacaactgacataacaacctctttcatagcattataatccaactctttattgccttgaattaaatcagagcctaaatttgaagtcataatcactacagtattacgaaaatcaaccgttctgccctgtccatcggttaaacgtccatcatctagcacttgcaataaaatattaaagacatcgctatgggctttttccacttcatcaagcaaaatcacagaatacggacggcgacgaacggcttcggttaaataaccaccttcttcataaccaacatagcccggaggtgctcccactaagcgtgaaacactatgtttttccataaactcagacatatcaatacgcaccatggcattttcatcatcaaacataaagttagccaaggttttacaaagttccgttttccctacgcccgttggtcctaagaacaagaatgagccaataggacgatttggatcagataatccggcacgactacgacgaatagcatttgcgacagcaacaaccgcctctgattgtcctacaacacgcttatgcaattcttgttccatacgcaataatttatctttttcgccctccatcatttttgcaacaggaatgcctgtcgcacgtgaaagcacttcagcgatttcctcatcggtaacacgatttcgcaataaagtcatctcttttccttccgcactttcagcttgtgcaagctgtttttccagctcaggaatacgaccatactgcagctcagacattttcgcaaaatcactgattcggcgagcttgctccatttgaattttggcattgtccagctctgccttgatgtgttgagcacccgaaagtgcggctttttccgccttccaaacgtcttccaactccgcatattcacgttctttttcaccaagctcttcctcaagaagatccaaacgcttgcgacttgcttcatcatcttctttttgtaacgcttgttgttccaattttaattgaataatacggcgttctaatctatctaaaggttgtggcttactatcaatttccatacgaatacttgaggctgcctcatcaattaaatcaatagctttatccggtaattgacgatcggaaatataacgatgagaaagggtcgctgccgcaacaattgccggatcggtaatttgcacatggtgatgaatttcataccgctcttttaacccacgtaaaatggcaatcgtatcttcaactgtcggctcaccaacaaataccttttggaaacggcgttcaagtgcggcatctttttcaatatattggcgatattcatctaaagttgttgcacctacacaatgcagttcaccacgagctaaacttggctttaacaaatttcccgcatccattgccccgtcagtttttcccgcacctaccatagtgtgaatttcatcaataaataaaatcacacgaccttcttcttgtgccaattctttgagaaccgcttttaaacgctcttcaaattcaccacgatatttggctcccgcaattaacgctcccatatccagagaaagaacacgttttccttttaagccttcaggtacttcaccgtttacgatacgttgtgccaatccttccacaatcgctgttttacctacacccggttccccaattaataccgggttattttttgtacgacgttgtaaaacctgaatggcacggcgaatttcttcatcacgcccgataacaggatccaattttccactttctgcccttgcagttaaatcaatagtatatttttctaatgcctgacgattttcttccgcaccttgttcattcactttttcgcctcctcgcaatttatcaatggcttgtagtaaatttttttgttttataccgcactttttcaaactttcacttaaagcacctttatcttcaaaaattgctaataaaaataattcagaggaaataaatttatcttgccgttgttgtgccagtttgtcgcataaatttaataatttgaccaaacttctggaaacctgaatatccccattattccccgaaacttgtggtaaacggctcaattctgtagttaattcattatgcaataatgctaaatttcccccacttgctgttaataatggcatgattgaaccatcttgctgatttaaaagtgcggtcattaaatgaaccggttcaataaattgatggtcttttcctatggctaaagattgagcttcagcaatagcttgttgaaatttagtcgtaaatttatctatgttcataatctctcctaaaattaatttctgcgtttcatcgtaaaaattaaccacataatgaaacgccttctattcgctcactagttaagtaagattaaacaaagatatttcaagtagaaaagtaaaataaatttagtaaaacctattaattaaatgaattttaataggttttacaataaatagagggcattaatgaaaaagttttttcccaaagaaaaacaacaataaacccaaaccgatgacgataaagccaataagttgccatacatttatcgatcgttgactcataccaattaaaccgaaatgatcaatgatcaaagcagtcagtaattgaccgacaataataaagaacagcatattggtgacgccgattttgggtgcaagaaagatagtggtaaataccgctaatgcacctaataaaccgccgatgagtttccataagggctgtttagggacttgttgtagtgctgaaaataaatccattttccaccagcaaatgaaaaataacgctatcgttcccatcgcaaaggaaacaaaggctgcaaagacaggttgtcccgagagagattgtgctaactgagtattaattgccgcttgtgctgctaatgcgatccctgcacataatgcaattaatataaatggaagtaacatttttattatcctttaaaaaattcagtgaaatgaattgcattctatacttttcaagcaaagatacaaaagctaaaatgtcgcaataatataaatcctataacatgtgctccaagttcaaactttttccataaaaaatgtatgatagacatgttattaaactaaatagcttttaagggaataattatgacaaacacaaacgtacaactcatacaagaaggcgtaaatctaatgctttccggtatgggctttgttttagtctttttattaattttaatttttgctataaaactgatgtctaaacttatcggttacttttcatctgaaccaacccttcctcagcaagcgtttattcctacaacagaattaaatgatttagagcgtttacgtccggttattgtagcagcaatagcacatcaccgtcgtcaacaaaatttataataacggagaatataaatggctactcacgagaaaaaaatttctataactgacgtggttttacgtgatgcacaccaatccctttttgctacacgtttacgccttgatgatatgctacctattgccgccgaactggataaaatcggctactggtcgcttgaagcttggggcggtgcaacctttgatgcttgtattcgctttttaggggaagatccttgggttcgtttgcgtgagttgaaaaaagctattccgaacacgcctttgcaaatgttattacgtgggcaaaatttattgggctatcgtcattatgctgatgatgttgtaaataaatttgttgaacgtgctgttgcaaatgggatgagcgtatttcgtgtattcgatgccatgaatgatccaagaaatatgcaacaagcgttaagagcggtgcgtaaaaatggcggacatgcacaaggtacattgagttatacaacaagtccggtgcatacgttagaaacgtggttagataccacagagcaattgttagaaatcgggatcgactcgctggtcattaaggatatgtccggaattttatctcctgtcgaggcatacaaattagtcagcgaaatcaaaaaacgctacgatgtgcgtttacatatgcactgtcattcaacgacaggtatggcggaaatggcattactcaaagccatagaagcaggtgcggatggcattgacacagcaatttcctctatgagcggtacttacggacatccggcaacagaggcattagtagctacattagataacacacagtacgataccggattaagtattccacaacttgagcgtattgctgattatttccgtaatgtacgcaaaaaatacgctaaatttgaagggcaattgagaggcgtggatagccgtattttagttgctcaagtaccgggaggaatgctgactaatttagaaaatcaactcaaacaacaaaatgcttcagataaactggataaagttttgcaggaaattccaaaagtgcgggctgatttagggtatattccactagttacaccaacctcacaaattgtcggtactcaggcggtaattaatgtattaatgggtgaacgttataaaactattgcaaaagaaaccgcaggtattttaaaaggcgaatatggccgtaccccggcaccggtgaatgcagaattacaagcaaaagtcttagcgggtgaacaacctattactgatcgtccggcagatcatctagccccggaaatggataaactatccacggaaataaaacggttggtaaaagaaaaaggtattcaacttgcagagaatgaaattgatgatgtattaattgttgcacttttccctcaagttggattgaaattcttagaaaatcgaggtaatccgaatgcttttgagccggtaccaaccaacgaagtaaaaacaagtgaaaaaccgaccgcactttcaagtagaaatgatagtgccgtttacacggttgaggtagagggaaaatcttttgtagtgaaagttactgaaggcggtgatattagtcatattacacctgtctcgaccgcacctagtacacaatcaacggaaccggcaacaagtgcaactacaaaaaatataccggtaaatgcacctatggctggaaatatctggaaagtactggtaaaagaaggacaacaagttgcggaaggagaagtcttgctcattttagaagcaatgaaaatggaaacagaaattcgagccgctacctcaggaactgtacagggtataaaagtgaaagcgggtgatactgtggctgtgggtgataccttattaactttagcgtaatcggagattaatatggaaagtattctcgccctattacaaggaacaggcattatgcatttaagttgggggcaggcaattatgcttgtcatcagcttgctcttactctaccttgcagttgtgaaaaaatttgaaccgctcttattgctaccgattggatttgggggactcttatccaatattcctgaagcgaatatggcgttttcggcactggaaaatttacttcatagcaataacaaccaacatttatctacgcttgcaaatttactgcatagcgataccgacgtacaggcaataaaacaggtactggaaaaagcaccggcgttgttacatgtgcaagcagaattattagcgaaagatttaggctataccgatggtgtgttgtccactttttatgatgtcgccattaattcaggtgccgcaccattgattatctttatgggggttggtgcaatgacggattttggtccattgcttgctaatccaaaaaccttattactgggtgcggctgcacaattcggaatttttgccactgtgctaggggcgttagcattaaacgggttagggatcattgaatttaccttgcctcaagcagcggcaatagggattattggtggtgctgatggtccaaccgctatttatctggcaagtaaacttgcccctgaattattgggggctatcgccgttgccgcttattcctatatggcattagtcccacttatccaaccgccaataatgcgtcttttaaccactaaacaagagcgtaaaattaaaatggtgcaactgcgtaatgtcagtactcgggaaaaaatcttgttcccgatcgtgttattggtgcttgttgctttattattgccggatgccgcaccgttattaggaatgttttgctttggtaatttaatgagagtaagtggggtagttgagcgtttaagtgatactgcacaaaatgccttaatcaatattgtaacaattttcctcggattatccgttggtgcaaaattagttgcagataaattcctacaaccgcaaacgttaggtatcttattgctcggcataatcgctttcgccatagggacagcgagtggcgtcctaatggcaaaattgatgaactgctttagtaaagataaaatcaatccgcttatcggttcggcaggtgtttccgccgtgccaatggcggctcgagtatcgaataaattaggcttagaggctgatcatcagaactttttattaatgcacgcaatgggaccaaacgttgccggcgtgatcggatccgccattgcagcaggcgtgatgttaaaatatattgcagcaatgatgtaaaaatcattcccttaagattgaaaataaaaataaggacgaaaattttcgtccttattcatttttaatacaatgttagaatttctctagtaacattttttccaatttttcttggtcaatagcaaacttacggataccgtcagctaatttctcaactgccattggatcgctattgtgttgccaataaaattggctttcggttaacggttgaggttttgctttaacttcacctttaaacgctaatttacgcacaagtgcggtgctattttcttgtaattcttttaataatgccggtgcaatagtcaaacgatcgcaacctgccaattcagtaatttcacctacattacggaaacttgctcccataacaacagtgttataaccgtattgtttatagtaattgtaaatttttgtaacagaaatgacgcccggatcttccgccggtgcatattctttcttatcactgtttgctttataccagtcaagaatacgtcctacaaaaggtgaaattaaataaacacctgcttcagcacaagctcgagcctgtgcttcagagaacaatagcgttaaattacaattaatcccttctttttcaagaatttctgcagcacgaataccttgccatgtagaagcaattttgatcaaaatacgatcgttgccaatacctgcttcgttataaagtgcgataagtttacgtgctttttctaccgttgcttgtgtatcataagaaagacgggcatctacttcagtagaaatacgtcccggaacaatttttaaaatttctaaaccgatatttactgccagtttgtcttctgcatcaattagttgctgtgttttatccgcactttttgctttcgcataagcaatcgcttcatcaattaatggagcatattgcggtaatgatgatgcacttaaaattaaagagggatttgtggttgcatcttgcggttgatattttttaatcgcatcaatatctcccgtatcggcaactaccacggtcatattacgcaaagcgtctaattgtgttgtcatagtctttccttttatttagctataaagaattgaactcgcatacaataccatatctttgaaattatgaaatcattattttacttttaagcgtacagaataagtatattcttcaccttatttataatgctttttagcacaattttatttataatcgagggcaatttttggcaaacaaaatagctcaacaatgaaaaaaaattattacactgtactttctctgtcaattttgaccgcactttatagcacgtccagtcaagcgaacttacaacagcaatgtttgatcggtgttcctcattttcaaggtgaaatcgttcaaggcgatcccaatgaattgccggtttatattgaagcggatcacgccaaaatgaatcaatcgacacatgctcaatacgaaggaaatgttaatgttaaacagggcaaccgtcatttaacagcgggaatgattgaaattgagcaacacggaaaagataatgcgaaacgttatgcgtatgctaaaaatgggtttgactacaaagataatttaattcagctcaatggtgataatgctaaaattcaccttgatagcaaagatgccaatatccaagatgcagattatcaattggttggacgacaagggcggggaactgctgatgaagttgaacttcgtgaacattatcgagtgatgaaaaatgcaaccttcacatcttgtttgcctaatagcgacgcttggtcaattgaggctaaggaaatgcgtcaacatattcaagaagaatatgcggaaatgtggcatgctcgttttaaagtatccggtatccctattttctacacgccttacctacaattacctatcggtgatcgccgtcgatccggattacttattcccaaagcaggtatctcaactcggcatggttattggtatgcacaaccgttttattggaatatggcaccaaactttgatgcgacatttacccctaaatatatgtctcatcgaggttggcaattaaatgcagaaactcgctatctgactcgtatcggtgagggaaaatttgtcgttgaatacttaaaaacagatcgtcattctgactctttaaatacggctcgttcacgtcatctcttttattggggacataattctcattttctaaaagattggcgtttaaatgtaaattatacaaaagtaagcgataaacattatttcaatgattttgagtctgaatatggaaacagtacagacggatatgtagatcaacaggcgagcatttcttactatcaaccgaattacaacctttctatttcagcgaaacaattccaaattttcgataaagtagatattggaccttatcgtgcgttgccacaaattgattttaattattatcgcaacgaaattgctaatggcttagttgactttagtttattttcacaagtagttcgttttgataatgacagtgcgttaatgccaactgcttggcgtttccatatagaaccgagtttgacttttccactttccaatcgttacggcagtttaaatattgaaactaaactttacgcaacacgctatctacaaaaacgaggtaaaggagaaaatgcagaagagattaaaaaaacggttaatcgtgttttaccacaaatcaagctggattttcaaacggtcttagcaaatagacaaagtttcattgaaggttatacccaaactcttgagccaagatttcaatatttgtaccgcccttataaagatcagtcggatattggtctaaaacaacaaaataatgattacttaggtttcggttacgactcaactttattacaacaggattatttttctttgtttcgagatcgccgttatagcggtttagatcgcatagtttcagcaaatcaaattactcttggtggaacgaccagattttatgataaaaatgcaaatgaacgctttaacttatctattggacaaatttattaccttaaagactctcgcacagataataatccaaaaaatacggctcaaggcagatcttcttcctggtctttagaaagtaactggcgtatcaatagcaaatggaattggcgtggaagttatcaatatgacacacatttaaaccaaacatctttggcaaataccgtcttagaatacaatccggagaaaaacaacttaatccagctcagttatcgctatgttaaccaatcttatatcaatcaaaatttgaaaggtagaaatacttatcagcaaagtataaaacaacttggtatgacaacagcttgggagctaactgatcattggacactggttggtcgctattatcaagatctcgcattgaaaaagccggttgaacaatatttgggaatacaatataactcttgttgctggtctataggtgttggagcaagacgttatgtaaccaatagagcaaatcaacgcaatgatgaagtgctttatgataatagcttaagcctcacttttgagttacgtggattatctccttcggatcataaaaataatatagatgaaatgctgaaaaaaggaaaactgccttatattaaagcctttagtctatactaacgttcaaatttaacgaaacacaccaaaaaacaaaccgcacattaagtgcggttttcttttagattatgttgaaaaattacagtacatcaacacagttcaaatcttcgaaagatttttctaaccgtttagacatagattcttctgctttgcgtaaccaaactcgaggatcatagtattttttattcggtgcatcaggtccttccggattacctaattgaccttgtaaataagcttcatttgctttatagaagtttaaaacgccttcccaagttgcccattgagtatccgtgtcaatattcattttaattgcaccgtagctgatcgcttcacgaatttcttccgttgaagaacctgaaccgccatggaatacgaagtctaatgatttcgccggaagattacgttctttagaaacaaattcttgtgatgcacctaaaatagacggttttaattttacgttgcccggtttatataccccgtgaacattaccaaatgctgctgcgatagtaaaacgtggactgattggacttaattgatcgtaaacaaaaaggacatcttccggctgagtataaagtttagattcatcaacatctgagttatctacaccatcttcttcaccgccggtaataccgatttcgatttccaatgtcatccccattttatccatgcgggcaaggtattcacgacaaattgccatattctctgccattggctcttcggataaatcaatcatgtgagatgagaacaatggtttgcctgtttcagcaaagtgtttctcgcctgcttccaataaaccgtcaatccaaggaagtaatttttttgccgcatggtcggtatgaagaataaccggaacaccatattctgccgctaatgtatgaacatgtttagcagccgcaattgcacctaatacatccggacgaataccgctagccggtttaattccttttcctgcataaaacgccgcaccgccgtttgagaattgaataataacaggtgcttttactcgtgcagcggtttctaatactgcattcacagaatctgtcccaacacagtttactgccggaattgcaaagttatttgcttttgcgtaagcaaatactttttgaacgtcgttaccggttaatacaccaggttttacaatgtctagtaattttgccatttttatatttcctatataacgtgcaattcttgcactactaaaaattaaatcaatctacaacgtaaagtataatgcttttcactttacaaaattaaccatttgctcgtttttctaaaatttcaaccgctggtaatactttgccctctacaaactctaagaatgcaccgccaccggtcgaaatataagaaattttatctttgataccgaataaatcaatcgccgccaaagtatcaccaccaccggcaatagagaaagcaccatttgcggttgcttcagcaatcgcattagaaacgatttcagtacctttacgaaagttagggaattcaaagacccccacaggaccattccaaagaatagtttttgcattgcggataatatcagccaattgctctgctgatttatcaccaatatcaaaaatggattcttctccggaaacgtcggctacacttttttctgttgatagtgcggtttctgaaaattcagtgcccacacgcacatcaactggaacaggaatattcgttacttttgataaacgttgtgcttcaggaattaaatccgcttcatataaggatttacccacattatgcccctctgcagcaatgaaagtattcgcaataccgccaccaacaatcagttggtcagcaatttttgataagctgtccaagacagttaatttagtggatacttttgaacctcccacaatcgctaacattggacgctgaggctcttttaatgctttacctaacgcctctaattccgccgctaataatggaccggcacaagcaacaggggcaaactctgctacaccgtaagttgaggcttgtgcacggtgagccgtaccgaaagcatccataacaaatacatcacaaagtgcggcatattttttacttaattccggatcatttttcttctcacctttattcacacgtacgttttcaagaacaacaatttcaccttcattgacttctacaccgtttagataatcttgcgctaaacgaacattaaaaccggcacctttcaaataatcaacaacaggctgtaatgaatcttcaggtttaaattccccctctgtcggacgacctaaatgagaagttaccatcactttagcacctttctcaagtgcaagttttaacgtaggaatagttgctttgatacgtgcatcggaagtgactttcccctcttttaccggcacatttaaatctgcacgaataaatactctcttacctgctaaatctaggtcggtcattttaattactgacataattcaccccttatattggttaaaattgataaaaactaccgcacattatacctagttatgaacaggttgtaacgaactagatcaaattggctttaatatcttgttgcataaattaaatcattaacaaaaaactcacgtttctattaataataattcaatctagaataactgaaatccctattcagttttcaacggatattctttataatcagccctttttacaacagagttaaaggacatggcgttactcatcactgataaatgtacaaattgcgatatgtgtttaccggaatgccctaatgatgccatttcaattggtgatgaaatttacattatcgatcctcatctttgtacggaatgtgtgggacattatgatacgcctacctgtcaaaacgtctgccccattaccaactgcattaaaaccgatccggaacatattgaaacggaagaacaactttgggaacgttttgttttaattcatcatgcagacaaaatataaaaaaaagggcgtataaacgcccttttttgatggatgaaaagtcaagaattaccagctataaccgatacctgcacccacagaagttttcttatcgccatgtcctaagctgaacttaacgctaagtttaccgttatcggacactctggaataacctaccgcaaaggcttgactccccatatagttaccggtcgccaaacttaacgtacttttacccggtaatatattgatcggtaagttcgcttgtgcaacagcttgagccacacccgcgcgcatattgcgatcattattgttcatttgtgtacgtaactcgtgatttctcgcatcgacatagtttttgttcactgccatatcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccactctcaagccgttgctgtctaaagtagattttctaccctcaacttcacgagtttcaaamgaagtcatgttcttcaactggtcagacaatttaacttctaagcctttgccgtcttgggacatttccactttgatattgccggcggcggtgaggtcgctgttaaatgttccctcgcctgtgatggacagggtttcacnnnnnnnnnnnnnnnnnnnnnnnnnnnnnnnnnnnnnnnnnnnnnnnnnnnnnnnnnnnacggcttgtaaatcgccaacggtagcgacattgcttaaattagcttggctatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaagggtgccgtctgtttcctccggtttaatatcagcaagaccggtgattttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctttgccatggacagttaaaccgtctttgccataaacggtatgggttttgtcgtcattggttgcgtctttatcacccacggttaaaccgtctttgatcaaggttgctttgccatctttgctttgtggcgtgagtgaaataccatctttatcaattttcactttagaaccttgattgccaacttggaaagtagcaccattatttggatctaaagtaagtttagtgacttcatcttgatttccaaccgcacttgaacctgcaccgcttccgcccgcacttccatttttaggcggtgaagaaattgattttatatttttcaaatcctcagtcgtgccaatggttaccacagccgttgttgttggggtagtggtggttggcgtggtagttggtgtacttgttggcgttgtcgtagccatgcctgcaccatttgaaccacctgacgaagccatactatttgaaccaccgccgtttgtacttgcactacctgacgaaccgcttgnnnnnnnnnnnnnnnnnnntgctggagcagctggtgttggagccggtgcggaagcnnnnnnnnnnnnnnnnnnnnnnnnnnnnnnnnnnnnnnnnnnnnnnnnnnnnnntactttaatattctgatcactcgtaaatttcaacgtatcgccacgaccgatttcrayagtytkaccgctaccattttcaaccttgaacttaaacttatctaacgcttgttcaaggtagcctttggtgatgagttcatttttccaatctgtacttccactatttcctcttccgccatcatatgtttgctctttagaaagcgtaactttgctaaatatcggtgcatttttaaagccgatttcgattttggcgttgccgttagtttctctcgtgtattgagtgattaaattatcacctttaaactcagcaatatttggttgtgatgaagtccccgccggagctggtgtggaagacgcccctgccgtatttgaagccaaacgaacaatattaatggttgagccgagatagtgcggtgtgttttgagtgccatttgttcccgcacttggcatatccgcactgaaywtcaagccttcgttgagtttcgttacagcatttttcaatccttcaacgatattttttggtgcagnnnnnnnnnnnnnnnnnnnnnnnnnnnnnnnnnnnnnnnnnnnnnttggagcagtaaatttcgttttatctgaagtactaacatcaacgcctaattgcttagtcaaatcagcgagttgtttacctgttacggcttcttttgaactctcagcaatttcaccgtctnnnnnnnnnnnnnnttttgaatcattaaagctgatttcttttttagctgtttctaacgtgatttttgctccactttcatctttaccgcttttaatactggtgatttcttgaagattattattaagcgtatgcgtaatttttccatccgcttccacagcaacagaaatattttccgacttcacgaagtctaacgcccctgttttgaggttgatagattgcttcgttttgtcatcactattcgctttatacgataaggtcaagccatcaacatatttcttattgacggcatcgtattnnnnnnnnnnnnnnnnnnnnnnnnnnnnnnnnnnnnnnnnnnnnnnnnnnnnnnnnnnnacagataccgcattggatacacctgttgatttattgcctaaaatgacagcatttgttatatctttagttgtcgtaatatttgaacccaaggcataaacatggtcgccctcaattttgttataagcacccacggcgtaagcatgcgttccgctaatcttattatctttaccgaatgcaccggaatcgttacccaatacattattttggaaaccaatagccgtagcatgctcgcccaatacctcagcttctctgcctatagaaagtgaacgtctatttttagcattagcaccatagccgatagcaattgcactttcattttttgccactgctttatcgccaatcgcaatagaatagtccccttcagccttagtttccggattatcggatactttaacggatttttgacctgtaccttttagatacttaataaccgcatccgcctgtactaattcagttgaacttttctcannnnnnnnnnnnnnnnnnnnnnnnnnnnnnnnnnnnnnnnnnnnnnnnnnnnnnnnnnnnnnnatattcgacccatcaacttttaagaagtctgtttctaattttgccgttggggtgtactctttcaaytywkywgcwacagctttagaagtcacgactttttcatcagtttcagaaaccgtggttgctttatttaaagtcagcgtaagtgtacctgcgtttttaacatcttgcccattagatggtgctaatgatacggtgatgtctttttgtgtcgcatctgttgcaccatcggcttttaccttgcttgtcgagctrtcaatggtcaatgttccgcctaattgtaatgtggttgagcttggggagctaccattatcattccccttgaatgtcaatccaccattaacggcggtgattaactcatcaatcgcccctttaaaggttgtaggacctgtattgctattagttgtatcaccagttgaacttgtaccgcctttaattgctgcaaaggttggtgctttaaacccagtttcactatcaacactaacccctaaatgagtagctaaatcagcaagttgtttacctgtaatggcttcggttgaactagtatcaatttttccagctgccacattagagattttcacggtnnnnnnnnnnnnggctttagtaaaggtcaacgcatttccgcccacttttaactccgctgttttatcagtgccacttgtaccgtttttaaacaccaaagcattatcgttatctttaccgatggttgataagccagtggcttgcactccgccatttgtcatgtcttttttcaacataacggttgagccgttttccggacttaactcaattttgttatccgctccattggtaactttaatactnnnnnnnnnnnnnnnnnnnnnnnnnnnnnnnnnnnnnnnnnnnnnnnnnnnnnttgaaccgtctttggcactttctaaagtcgccgttttgtctttcaattcaagttttganttgtctttsgyrctttctaargtsgcastgttytcagtgagtttyaacgccccyttrtccgytkcyttattaatytcagaaacaccgctaaatttaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgtttaaaagacggtttatctttgataccgattaacagctctttgctggttggttgataggttgtcttaatattatcactactatatccatcatcactggttgattttttatcgatattccccgctttaatctgcaaggtatcgcccagttgaagcgtgccagttgcagtaccgtcgccaatgacaagccctttattcacagccacgatcaaatcatcgattgcttctttaaaggtagtttttccgttagttgctgtttgcccttgataattgactttggtaaaggacggttgtgtaaatccagctttcgcattatcgacagtcacacccaatttgcctgccaaatcatgcaattgttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccagttaaagccttcaatccactttcaataactattttagaagccccgccgtcaccgtgttgaactttaacatctccagtagccccatcaacagtaatttttcctgttttatttgtagcactatgaccactactatcttttagagtgatagaattaatgtcttctaagtctttatttagtgctaccgtaaattctcccgtcttatcagaatttgttttagataatgaaacattgatattgcttcctgatttaatgacaacttttttgtcgttctcgctattttttctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttctttaaatatcggtttatctttgataccgattaacagttcctttctagttggttgatagcttgtcttaatattatcactgctaaatccatctacatcagattttggtttatcgatatttcccgctttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaaatatcacccacatttttaagctgattccccgtaatcgcctgatcggaagtttgcgaaatttcgccatcagccaaatgtccaaattttattgtttcccctatgtcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgttccatattttgtatctaccttatagaagttgccatctgttcctttaactaatttatatatttttccattatcttgcgtataataaacgactaagccttctctttttacatattctaaggcttttaattgcccaatcgtcgccacgtcagagtccaacgcacccggtgctaccccgacaatccgtcttaagcccagttcttgacttccactgttaccctttgtccaacctaccgacacaatacccgctgttttatcggttgttaagttatagctagaaccctctggaacataaggggctaactcaatcgcctcttttccgnnnnnnnnngctgtatttttgttagcatcctgataaaaatattttgtatgtgatttataacctagtgctacggagttttccatcgtagactgtgcttcattacctaaagcgattgaacttactttagtagcctttgaatttgtcccaaaagcaattgcattttcagaatttgcttcaacttttgcgttatctcctaaagctatacctttttcagaataaacatatgattctgtacctatagaaatagctgacatatccaactctactnnnnnnnnnnnnnnnnnnnnnnnnnnnnnnnnnnnnnnnnnnnnnnnnnnnnnnnnnnnnnnnnnttgattttcaayttttgcactatttcctatwactatwgattttyytgcatkwtytttcaaacttgcatcatttcctaaaactatactttctcctgataaaccgtgagaaccatatcctattgatattgtattgtcttttgttacaccwaccccagaaccaatggcaattgctcccgctcctgttacattaactcctgttccaattgcaacagagttttctttaaatacatttgtaccaatcccaagtgctattgtatttgttgcatatttccctatattatttaatgctcccaaaactaccgagtttgatcctcttactatagatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttggttagaggcttctgcctcattacctayagcaaatgaattmgswgcaaawaccctagatkcgtcwcctatcgcwaccccgccwtctgcatykktwtcaacraatgcacgracaccaacagctgtwgagyytttwscyaaagcaaatgataakgtwcckawwgmaagtgaagyatcwccawakgcaacagatcttgacccaatagctattgatcccactcctgctgcgtatgtcggtgaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatcatcattccctattgcaatagaagcataaccagcagccattacgtccgatcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttcaccccatttttcttgtacacctgctgctcctgtccttccgtccatatcaatatatgttatgtcagcatatgaaacactgctcacaccaagcatccccgacatcaacaacaccaacggtgaaaatttaaaaatgcctaaaaaattacccaaaaacacaccgcactttgatttactcttcgaactgctcgctatttggcggttgcttgccaactcggaaacagctttacattgacctgttgtaatatcgtatttggttttaaatattttgttcataaattcactcgctttaagcttttaaaattaggttttttattgatttattttgttgatttttttaacttttttacggttgtttattgattaaacgtgttactttttagatagattaatgaggtataaatcggcgatgccttgctttttaagacacaacaaaaaaaggcgaataatactttcgccgaaaggttgaggttgaaataggtgatttttaagatattgtttgaacatgtccaacctctcaaaattaacttgaaaggttgattttagccaatacactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcattttattcctgtgatatgtaatgtacaaataatatatcgggccgattattctaacctaaatattatgaaaaacaaaaggattttttagttaaatctgatttgatgtaagaaggctttagtgcgttcatgttgtgggttttcaaataacgtttttggcgatccttgttccacaataatgcctttatccataacgaccactacatctgccacatctaaagcaaatttgatttcatgcgtgactacgaccattgtccaaccttcgttagcaagctctttcattgtgtttaatacatcttgaactaattcaggatccagtgctgaggtaggttcatcaaacagcattaattcaggtcgaatagctaaagctcgtgcaataccaactcgctgttgttgtccgccggaaagttggtgtggatagagattagctttgtctatcagccctactttacataataatgtttccgcttcttggcgtacttcatcaggattgcgttgttgtacttgaacaggtccttccatgatattttctaatgcggttttatgtggaaataaattatattgttggaataccatgcctgattttttgcgtagcggtaaaatgtttttgcgaatgtgtttgtccgtaaaatcaatatatagcggattttctttgtgaaattcgattgtgccttgttccggtaattcaagggcatttaaacaacgtaaaaaagtcgttttacctgaacctgatggtcctaagatgacaacaacttgacctttttctatatctaaatcaattccacgtaatacaggattattgtcaaatgttttatgaatattacgaattttaatcatcatttatcctttgttagcgagtaacataacgagcaagttttttttctatgcgagcttgccataagaacaagataaaacagaaacaccaataaatcagggctgcctcaatataaacgggtaagaaatcgtaagacatatttgctacttgttgtgccactcggaacatttccgttactgttactaccgaagctaatgaagtgtctttgaataaactgataaatgtattactcagaggcggaacggcaacacgaaatgcttgcggtacaataattcggcggaaagtttgcatataagtcatgccgattgtgtaaccggcttcccattgtcctttggggacggattgtatcgccgctcgtaccgtttcagaagcataagcaccgacatttaatgagaaaccgataattgcggcaggaataggatcaataaaaatccccagtgcaggtaatccataaaaaacgatggatatttgcactagcattggtgtcccacgaataattgaaatataaatttttgttataaataaaaagaggcgatggataatgctatggctcggactcactcgaattaacgcaacagcaatcgcaataaccattcccaatataaatgatacgatagcaagcggtattgaaactaataccgccgctttgaccatgggaaaaaatccattgatgactaattctgctcttgcctcagtcataaaaggcaatgaggcaaggaaattatttaacactgatatctctaccaaagaattgttcacctaattgttttaatgtgccatcgttgcgtaattcttcgatagcggcactgatttttgctagtgcttcatcattatttttattgacaataagccccgcacccactttatctttagattcccataccggttttaaacctgaatttgggtattttttcaaataatccaataaggctagtgcatcgttaaacgtcatatctgctcgtttttgttgtatgagtaataagccttgtgccatgccgtcaataggaacaatcttagcttggtatttttgtgccaattcaccatagtttgagctaagtgtttgtgctgcttttaagccttttacatcttcaacttgtttaatgcgagtttcattatctcgtgctactaacattgctccggaccaactataaggttcagatttgtcaaaagtggcttgacgttcaggtgttgttaatgcgacttggtttgctaccaaatcaaaacgtccagcttttaaaccagcaagcatcgcgtcccattgtgtttctttaaattcaacggttacacctaattttttagctactgcacgagtcacttcaacatcatatcctgtcaattttccggttgagtcgtggtaagtgaacggtgcgtaagtgccttccgtaccgaccgtaatcgttcctttgttgttaatgcgatctaataaactcgcctgtgctaaggcttgtgtgttggcgactattgcaaaaacggtagtgaataaaaatgttatttttttcaacataaaagctcctttcagtaaaaattgcgttgcggtaaaaaagagtgcttggcattgtaaaagaaatgttaaatattacaaataactttcgggaatatgttatgcagaatgggtgtttttatnnngcgatgaaaaatgatccggattcaacgcccaaagctcaagctgaaaaattaggaagcgagtaaaggaaaatcaagcgatatttcgttatggcacttgaaataatactgaataatagctatattacgacaaagggcgtaagctgccacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatgagctttgataagtgaattaggacttaaaaaagctcattttgttatatcgaaaaggtcaatgtagccagaataaataggcaaatgtgccgataaacagtacgcaaataatatttaagacaacacctgcacgaaccatttctttttgtttaatttcgcctgtaccaaagacaattgcattcggcggagttgcaaccggtaacatgaaggcacaagaggcacctaaaccaatgatcaatgctaaacctaattcaggcatgccaagtgaccgtgcaatagaaatgaagataggaactaataacgccgcacttgcactgtttgaggtaaattcagttaagaaaatgataaaggcggcaactaataaaccgataagatagaagttcccaccttcgatcatgaagactatgccgtcagccaaaactttgctcgcacctgagtcttgtaataccgcacttaatgttaaaccaccaccgaaaagcattaatacgccccaatccgtattatcttgtaactgtttccaagaaattacgccactgacgcaaacggcaatagcggcaagtaatgcgatgacactgtcaaaactggcaatatttttttccaaccctaataaagatgacagcattgggttgagtttggcactaaatatccagcaaaatgcaatagttacgaaaatgagtaatgtaatgatccgttgattattcatctcaactttctcaaagttttgtttgaaactcgccttgagattcggtttaaagataatgtaaagagtaccgatcatgattggcataagaataagcatgataggtaaaccgaaatagagccaatcggagaaagataatttcaattgagaagcaacaattgcgttgggcggactaccaatgacagttcccataccgccgatactcgcactgtaggcaatacctaataagacgaatacataagtgttatgttctttcgttctatctaattggctaagaatacccatagctaacggcaacatcatcgaagctgttgccgtattactcatccacatagacagaaatgcggtaattgagaaaagataaatgacgccaataaagagatttccttttgccagcatcattattttattggcgatcattctatccaatttttgaatatgcagtgcggtagcgagggcaaatcctccaaagaaaaggaaaatagttggtgctgaataagaagctaaagcggtttttgttgtgactaaacctaatgcaattgctataaacggcactaataaggctgttactgttacatgcagtgcttcagttagccataacacagcaataaagactaataaagccagtcctttatttgctttttcatcaaagggtaaaacataaagtagaacaaaaaaaacgataacatcaagaatgaatattaacgcattttggttaaaaattgatttagaaactgttttgctcataaggttatcctgcttagataaaatattgaactatccctatttgggggtaggaatttgagtgaaagttaccaaatggtaaaaaaaatgcaacgaccttttgttttttttgtgaggtatgtctaaaaaataaaaagtgcggtcttttgaaccgcactttttgtaggaattaatgctgaatggtgattataagctatcaaactcttctaaatctaaaggctcttgagaaagaataatgccggtaagatctgcataaacatagtcatcaggaaagaaggttacgccaccaaaatttaccggaacgtccgtttctcctatgctttgttcatctgaaccgacagggataggtgcaagtgcttgaataccgatatttatgttttctaattgttgtaattgacgaattgctccgtatacgataatcccttcccagccgttatctgccgctaattgtgctaagtttgcatcaattaatgcacggcgaaccgcaccgccaccatcaattaatagcactcgaccttcgccattttcttcgagaatttcactgattaatccattgttttcaaagcatttgattgtggtgattttcccaaagaacgtgcttttgccgccaaaactggaaaaaataggctcaacaacatcaatttgatcgaggtaaatatcacaaagttcagcagtatcaatatacatagggttttccttctatatttcggacagttgttaagtataaccaatattagtttacaagcaagctcaaactgaataatagattcgtgaacaaggcaagtaaggacatttgtgcaagcattgggcgtaaatataacggatttttattgcgatacacaaaatgtgcatgcttgatcagcagtggaaaagaaagaataaagataaaatttgaccaatgtgtaaatgtgtataaggcaaaaataatataacttaatgcactgagcaatagaataatgcaatgataaatacgtgcattctcagcccctagacgtactacaagggtatttttacctgcttttctatcttgttcaatatcacgcaaattattgatatttaataccgcagtagctaataagcctgttgcggtagcagggagaaaaataagccaatttagctgatgggtttgcagataataagtaccgccaacaccgagcagaccgaaaaatataagtaccgaaacatcgcctaaacctaaataaccataaggttttgtacctacggtataagtaattgcggcaagaatggcgagtaaacccaaaagtgcaaaggcaacaagatcaacaattgtttgataagcattcacaatcagtaaactaccggaaatcaaactcaagaatacaacaagaataagtccttgttttaattgttttgcgttaatagcaccttgttgaatagcacgcaacggtccgatacgttcttgtgtatcggaacctttttgatgatcgccataatcattggcaaagttggataaaatttgcaatagcaaggtcgttaataaacaaagtaaagttgttgtccaactgaactgttgtgaccaataagccaatgctgagccagtcataattgaggcggcagccaaaggtaaagttttgggtctagctgtttcaaaccacattttgacactattatttgccataatatccacattataattgatacagaaaatgaaattttcaccaagcgtgtaaatttgcgttattttactgttttattaatgaatttttaactgttttaaggaaaatatgtctaaatttttacttcatcttacgccgattgcaatcattcatacgccgtataaagaaaaattttccgtccctcggcaagcgaatttagttcaagacgggacaggtattgtggagttgcttccgccgtttaattgtccggaggctgtacgtggactggagcagttttctcatttgtggttaatttttcaatttgacaacgtgccgacaggtaaatggcaacctacagtacgacctccccgtttaggaggtaataagcgtatcggtgtttttgcttccagatcgacacatcgccctaatcctttggggttatctaaagtggaacttcgtgaagttgaatataaaaacggaaagattttgttacatctcggttcagtcgatttgattgacggtacaccaattttagatattaaaccttatattgcgtatgcggataatgaaccctgtgcaagatcgggatttgcccaagaaaagcccgagcaggaattgcgagtggaatttagtcctgaggtgcaaatagtattagcaaaattagagaaaaaacgaccgcacttaaagcgttttattcgagaggttattcagcaagatcctcgacctgcctatcagaaaggaaaaaatttgcataaaatttatggtatggcactgtatgaatttaatgttcgttggagaattaaacatgatgatgttacagtggcggaagtgattcacattcagcatgtttgatcttcaaataaattttttgatccacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcataaaatttatggtatggcactgtatgaatttaatgttcgttggagaattaaacatgatgatgatgttacagtggcggaagtgattcacattcagcatgtttgatcttcaaataaattttttgatccacttcacatttttacagttttcttttttctttttatgaaattttccattaaactactttttgtttaatcgaaacgtttcgatgataattatcaatgtttcctctgaataatttcagaaaaactggagaaaattaatatgaagaaaacaaaattattaaatgcgagcttatcacattatattgcaacgttaggccatacagacagtttggttatttgtgatgccggattgcctatttcaaatcaagttgaacgtattgatttagcgttggaggcaggcgttcccgcctttttacaaactgttgatgtggttataagtgagatgtttgtggagcatgccgttgtggcgaaagaaattagagaaaaaaatccgcaaattcatgacgcacttttagattcgttaagaaaattatcagaacaacaaggcaactgcattgccgttgaatatgtagaacatgaagaatttaaagtattaagttctgagagtaaagctgctgtacgtacaggggaattctcgccgtatgctaatattattttgtattcaggtgtgccattttaaccagttgaagagaggtatttatgcaagtggaaaccttgctcaaaattaccggtgtagataaatcttttccgggtgttaaagcacttagtaatgcttgtttatctgtttatgcgggacgagcaatggcacttatgggagaaaatggtgcaggtaaatcaacgttaatgaaggttttaaccggaatttatagcaaagatagcggttctattgaatatttaggagatgttgtcaattttaaaggacctaaggattctgaaacggcaggaattagtattattcaccaagaactgaatttagttgcaaatttaaccgttgctgaaaatatttttttggggtgtgaatttacaacctcttggggagcaattgattggaagaaaatgtacagagaggctgataaattattagcacatttgggtgtgtcatttcgcagtgatcagctttgttcggaattgtctattggtgaacaacaaatggttgagatagcaaaagcgttgagctttaaatcaaaagtgatcattatggatgaaccgacagatgccttgacagatacggaaacggaaacgctttttaacgttattcgtgaattaaaagaacaacattgtggcattgtatatatttctcatcggatcaaagaaatttttgaaatttgcgatgatgtaacagtattacgtgatggacagtttattggtgaaagtgcggtgcgagatctcacggaagagcgtttaatcgagatgatggttggtcgccgtttagaggagcaatatccgcatgttgaacaagatcgtggttctgttcgtttggaagtaaatcagcttttcggtagtggaatatgtgatgtgagctttaaactatatagtggtgagattttaggtgtgtcaggcttaatgggtgctggtagaactgaattgatgaaagtgctatatggtgctttgcctaaagaaaaaggtgaagtgcggttaaataataaagtcatttctaataattctcctcaagacggtttaagaaacggtattgtatatatttctgaagatcgtaaaggcgacggactaattttgggtatgtctgtaaaagaaaatatgtctttgaccgccttggatcatttgtcaaaagccggaaaaattaatcatcaagcagaaaaaatggtggtagatgattttattgagttgttcaatattaaaaccccaaaccgtgaacagcaaataggcttgctttctggcggcaaccagcaaaaagtggcaattgctaaagggctaatgactcgtcctgatgtacttattttagatgaaccgaccagaggcgttgatgttggtgcgaaaaaagaaatctatcaattgattaataaatttaaacaagagggattaagtattattttggtctcatctgaaatgccggaagtacttgggatgagtgatcggattttagttatgcacgaaggtcgtattagtgctgaatttagtcgtgaagaggcaacacaaggaaaattacttgccgcagcacttgggaaacataattaagggaattgtatgaaatcatcatttaaattgggaaaaatgttattagagcaacgttcagttattgctttgttgatacttattgctattgtatcaatgattaatcctgactttttcagtattgataatattcttaatatcttacgtcaaacgtcgataaatgcgattattgcagtaggtatgacttttgtgattttgattgcagggattgatttatccgtcggttctattcttgcgttgaccggtgcggttgccgcttcattagttagcatggagttatccatttttatggttattccgttaacgctattattggggacttttttgggtagcgtaagcggttttatcgttgcaaaaggcaaagtacaggcatttattgccacattagttaccatgactttattacgtggtatgactatggtttatactgaaggtcgtccgattagtacgggattttctgaaacggcagacagctttgcttacttaggtacaggttatttattgggtattcctttgccgatttggttaatggtaattgtgtttgcggttgcttggtatgttttaaaacactgtaaaatcggacgctatatttatgctttaggcggtaatgaaaatgcaacgcagctatcaggcataaatgttaatagaattaaaatatttgtgtttgcagtgagcggttttttatccgcacttgccggattgatcgtcactgcacgtttatcttcagcacaaccgacagccggtgtgtcttatgaattagatgcgattgccgccgtcgttgtcggcggaaccagtttaatgggcggtaaaggtcgtgttatgggtacattaatcggtgcattgattatcggttttttaaataatgcactgaatttattagatgtttcatcttactatcaaatgatagcaaaagcgttggttatcttaattgcggtgcttgcggataactatttaggtaacaaaaaagcataaactcaatatctttataggagattttaaaatgaaaaaattaacaactattgcatcagctgtcatgttaagtcttgcttttagtggtgtagcaatggcaaaagagacaattgcattagctgtgtcaactttagataacccattctttgtgtcacttaaagacggtgcacagaaaaaagcggatgaattaggttataaattagtcgtgttagattcgcaaaatgatcctgcgaaagaactggctaatgttgaagatttaatggttcgtggtgcaaaagtattattgatcaacccgacagacagcgaagcagtttcaaatgcggttgctattgccaatcgtcgtaatgttcctgtcatcactttagatcgtggagcggcaaaaggtaaggtagtgagccatatcgcttcagacaatgtagccggcggtaaaatggcaggtgactttattgcacagaaattgggtgcaaatgcaaaagttattcaacttgaaggtattgcgggtacatctgctgcacgtgagcgtggtgaaggtttcaaacaagctattgcagaacacaaatttgacgtattagccagtcagccggccgatttcgatcgtactaaaggcttaaacgttatggaaaatttattagcaagtaaatccgcagttcaagctgtatttgcacaaaatgatgaaatggcattgggagcgttacgtgctattaatgcggctaataaaaaagtactggtagtcggttttgatggcactgatgatggtgttaaagcagttaaaagcggtaaattaggtgcaactattgcacaacaaccggaacttatcggtagtttaggcgttgaaactgctgataaggtattgaaaggtgaaaccgtcgcagagaaaattcctgttgacttaaaagtcattgttaaataataaagtgaggacatatttattgtcctcatttcttgatataaacaataagggcgattttgtttattttctgataaggataaatgatgagtaaaactcttactgttcttggtagtattaatgcagatcatgttatttctgtaccgcactttgccaaaccgggcgaaacactaagtggtaaacaatatcatattgcttatggcggaaaaggtgcaaatcaagctgtggcagcagcaagattagcggattttagccaaggtgcaaaagtgaattttattggttgtatcggtgatgacgatattgggcaagcgatgaaaaaagcatttgcacaagatggtattaatgttgcaacgattactgaaattcctaatgaaatgactggaattgcaatgattcaagtggctgatagaggagaaaacagtattgtcatttctgccggtgcaaatgcatatttaacgcctgagattgtagataaatttgcgacagaaattgagcgggcggattatttactcatgcaattggaaacaccgttgaacgcaattttggaagcagctaaattagctaagaaacatggtgcgacagtcgtattaaatcctgctcctgcgagccaattacctgatgaattgctcagtttattagatatgattacgccgaatgaaacagaaacggaaattttaaccggtgtgaaggtaaccgacgagcaaagtgcggcgaaagcagcgagtgttttgcatcaaaaaggtgttgctactgtgttgattacgttaggttcaaaaggtgtttatgtgagtcggaaatcttcgacacaagaactggggcaaaataaggttatagccggattcagagtaaatgctgtagatacaactgcagccggtgatacgtttaatggggcatttttgaccgcacttttagaaaataaatctcttgacgaagctattcgttttgcacatgcggcggcagcgattagtgtgacgcgtcaaggggcacaaccttccattccaactcgtcgagaaacattagactttttggcacaacattaattaatgtaagggcgttgaagatggctacaatgaaagatattgctcgaattgcacaggtatcaacgtccactgtttctcatgtgattaataattcacgttttgtcagtgaagaaattcggcagaaagtcatggcggtagtggagcaactgaattatacgccctcagcattggctcgcagtttgaaagtcaaagaaactaaaacaatcggcatgctggtaactacgagtgataatcctttttttgctgaggttgtggcgagtgttgaacgttattgtcgccaacatcattatcatttgatcttatgcaataccaatgatgacagtatttgtttgcaagaaaatctgcaaaatttgatacgcaagcaggtcgatggattgctcttgatgtgtacggatagtgcctttgaaaccagtcctttaaatttaactgttcctactgtcatcatggattggtggccgacagagctaagtgcggataaaatttttgaggattccgagctgggcggatatttggcgacacggactcttattgagcatcaacatcatgatattgcgattattacgggaaatctgaaaaagcctcttgctcgtaatcgtttgaaaggctataagcaagcgttgcaagaatacaacattcctattcgtgataaatggattattgaaagtcattttaactttgaaggcggaattaagggaatggaacagttgttacaattgaaacagcgtccaagtgcggtgtttgcttgtagtgataccattgcagtgggtgcttatcaagctgtttggcgtcatgggttatctgtgcctgaagatatttccattattggttacgataatattcatttagcacaatatctttctcctccactcagcaccgttcatcaacctaaagatgaattcgcacacttggcagtagatacattgttgcaacgaataaaaaatcctaccgaaagttaccgcacgttgacgttaaaacctgagatagtattgcgtcaatctatttgttcctgttttttgcctaagtccgcatagaaaaaagaccgcaagtgcggtctattatttatctccaaaatttccaccagcttgtgcgttttgcttccggaccttgaatgattgtattattgatatattctttttcaacatcaggtagcggtttatctaaattaacgtcggtgacaataccgcgtcgatcaaaattcacaataaaagtatgttgctcaggtgcattataagatttttgttgtaaaaatacgtagtaccaagtttgattgctaaatggatctattagcattggcgtaccaagtaagtactgaacttgttgtgcattcatgcccactttcacttgttctacagcggtagattctaaatagtttccttgtggaacatcaatacgataaacgattttttgaacactggaacaagcggtaacgcttaatcctaaaatcatagcaggaataataaattttaatcgcatattttgtttaccttaactcgtgcaaataacgtcgtggataataactaaaattcgtaaaattgccaacttattcttttgtttggcgttgtagttgatcgcgtaaattcggcggtagtcctgtaatggttaaactatccgttgcttcatcccaaaatatacggctgtttaataactcggcatcaaaacttaatgtgataccttttcctgagccggaaaatttagtcaacgattttaatgcagtacgtacgggaggaatattttcttctaagccataattttggctgacagcgaaatcaacaaaagactgttcatttagagtgggtatattggcagaaagttccgtgacaacgatttcttcgcctacatttatttgtcctttacaataatcgaatacttgttttttgaccgcttgagtttgttcttttgtcaaatccgcctgttggcagtagtcactaactgcttgtaataaacattgattttgcacttgaggatttaatccctcttctgcacctaaaaaatccataaaaaagtcagcaattttgcgtccaactcgacctttaataaaagtcagataacgagttgattttgcatctaaatgcaattcggttaaattaattcggcaagcaatatcaaattgagtaatatcaagataatgcgtttgttttatttccagattttcatcaaccaacatactatagcggctatctaataatgcgatgaataaataatctgttgcgagaaaattgtattgacacaaaattaacgtgccatcattggcaaaactgtattttcccaactcttgacgtaataattcggctgattgatgactaaatgccaagaaatcaatatcgttttccaatgtgcggttgagtatttgagcaaaatttgaggtttcttggaatactccataggcttttgttttattttgatactcttgatgtaattgcaacatcatttgttctgtttccgctgtaattggtaataattcatcacgtaaatgcgttttaagttgaacggtattttcatcttgtgatgttttaaccaattgatgcaaaacaatttgattaactataatgctcattttgttcaaatcctgtttatgataaaaattcttaatattataaccgcactttaaggaaaatatgctagtatgtgtccaaattattcgtttctatttatatttagcgtacaaaattaaatggcaaaaatttcaaaatttcaagataaacaagtcgaggcaatattgaatgatatgatcgctatactggaaaagcatcaagctccggtagatctttctttagtcgtattgggcaatatggtaacccatttgttaaacagtagtgttgggtcgcaacaacgtattgtgttggcaaaagtattttccgatgctttaatgaattcagtaaaaaatagtaaataatatgtttggaattaaaacaagcaagcaatatcgtgatgaattatctcgtaagattacgtggggacattggtttgctttttttaatattttgtgggcaattgttattggtagtcgttatgcctttattattgattggccgcatactttattcggtaaaatatatttttttattagtttattggggcatttcagcttcattgtttttgctctctatttgctcgctctctttcctctcagttttattataaaaaatgaacgcacttttcgtggtataagcgttattttaacaacgataggtgcaaccttactgttggttgatacagaggtgttttctcgttttaatttacatctttcaaccctcgtttggaatttgttggttaatcctgatgatggtaagttatcttataagtggcaaatattttttgcacctatgccattgattttatttgttcaaatgcttttctcacgttgggcatggtataaattacgcagtttagagagacaaaaatggattaaaggtgttgctcttgtatttgttgttagctttattgctacacatattctttatgcttgggcagatgcgtatatttatcgcccgattaccatgcaaaaatcgaatttccctctatcttatccaatgacagcacgttcatttctcgaaaaacatggtttcttaaataagtctgaatatgaaaaaaccttaaatgagcaaggtcgtcttgatgcgttaaaagtgaattatccaaagcagaaattgactttttccgatgagttgccaaagacgaatattgtccttatcaccattagtggattacgtcatgatgcagttcgacaggatataatgcctaatttatttgcattttctgagaattcaactgaatttactcatcattacagttcaggaaactctcttaatcaaggtttgacaggattgttttatggattgaatgctaattatgcggacagcttacttagcaataaaacaacacctgtattaattgagcggctaaaacaaggaaaagtgcggtatgaaatcggtctatttggtcagaatttatctcgaagtatattattgaagaaaagtatttttgcaaatgagaaaataagaaatgacaacaatgcctttacgcggcgttttattgagtttgttaatactcgacaacaacagcaaaaattattttttgcctatctaaattattcactgaacagcaatttgactattgaacaatattatcaaaagttatctgaaattgatgatgagattggttcggcatttaagtcgatagattttactcataccattgtgatagtgacttccgaatatggttatagttttgatttttctgataaaaaaagaccaactaattattttgcaagagaagtaattcaagttccaatgattataagatgggaaaatttacctatcggtaaagtgaataaattgagtagtcataccgatttggtcccagccttaatgaaacatatttttaaagtaaaaaatccaattagcgatttttctcaggggcaggatttatttgatttggatgataatcgtagttgggttcttgctggtaattaccgttggaatgtaatcattacaccggatgattcgcaatatcatattgataggaatgggcattatcaaaaatacaatcaacattatcaaaaaatttcgtcaacacaacctccgttaggattattcttagaagtattttcacagaatacggctttcatcgaaaaatagatttattagaggtaagccgttttccgagatgagaatgctaagagtggaagcgtattctgttttataaaaaaaagcgtttcttttgtgggggaagaaacgctgaaatgttggagtgattatctattattgtttgagtgatatagatgataattgttctcaaatagcttgtcaataaataaataaaaattattatcaattttttttcttgtctttaattattctaggtaattcactaaatttgttagataaagtgcggtcggtttttgatgagaaaaatcaaattttacagcatagctataaacttcaacaccttctttaactgcttgctgcagtaattcggcataatcaggatcaatagattttgcaacggtgaagcgattaaaaccgtcgtgaagacctgcgaaaaaaacgaccgctctatgtccccgttttttcattgctataagctcacgtaaatgtttctgtcctcttgttgtgacagcatcagggaacaaaccgagatgatttttgacaaacgtaacggattttacttcgacataacaatcaggtaagtttttacctttgagtaaaaaatcaatgcgactattttctacaccatattttacttcaggcaaaatctcatcatattcagctaattctgtgatgattttattttgcaaagcctctaaagttaattgattggaacggtgagtattgatacataccgtttgaccatttttaagttgagttaattcccaagagtgcgggtattttcttgttttgctgtcagaagtagaaaaccaaacagtatcgcctttttcaccacatcctgtcatcgcaccggtattggcacaatgaagcgttaaaatttcaccgttgtttaattctacatctgccaaaaagcgtttataacggcgaagtaatgttgctgattgtaaattcggtaattgcataaaaatccttgttatccaacagtttcagtaattttaccagctttatctgaaaaaaattttgattgaagcaatagttgaaatttttaagaaaatagctttatttttagcgaattagtggtacatttactccgcttgactttttgtcatcttaaaggatgggcgatattatctcccaatttttttaatcaatcaatttgaaggaaacattatgttaattggtgtacctagagaactgcttgataatgaaagtcgtgtggcggcaacgccaaaaacggttcaacaaattttgaaacttggttttgaagtgattgttgagaacaatgccggttttaatgcgagttttgaagatcaggcgtttgtaaatgcaggcgcaaaaattggttcggcacaagatatttggaatgcggatattatttttaaagtaaatgcaccgacagatgctgaaattgcacaaattaaagaaggtgcaacgcttattagctttatttggcctgctcaaaattcagagctaatggcaaaactttcttctaagaaaattaatgtgttagcaatggatgctgtgcctcgcatttctcgtgctcaagccttagatgcgttaagttcaatggcaaatatttccgggtatcgtgctgttattgaagctgcacatgaatttggtagcttttttacagggcaaattacagctgcaggtaaagtacctcctgcgaaagtacttgttattggtgcaggggttgcagggcttgcagcaatcggtgcagctaatagtttaggtgcgattgttcgtgcatttgattcccgtccggaagtaaaagaacaagtgaaatcaatgggagcggacttccttgaaatagatttccaagaagagggcggtagcggtgacggttacgcaaaagtcatgtcagaagaatttaatcgtcgagcgatggcactttatgcggaacaagcaaaagaagtggatattattattaccacagcagcgattccgggtaaaccggcaccacgcttgattactaaagaaatggtggattctatgaaaccgggtagtgtgattgtggatcttgctgcactgacaggcggaaattgtgattatacgcaagccggtgaaattgtggtaactgaaaatcaggtgaaagtcatcggatatacagattttccaagtcgcttaccgacgcaatcctctcaactttacggcacaaacttggttaatttattaaaacttttatgcaaagaaaaagatggcaatatccatattgacttcgaagatgtggtattgcgtggtgtaaccgtaattcgtgatggcgaggttacttggccggcgccgccgattcaagtgtctgcacaaactcaacaaaaaacaaccgcacctgttgtggataaaaaagaaaaaacgccaataaatcctaaagtgaaatatggggtaatggcattggcgggagccgctttcctatggctcggttctgttatgccggctgcatttttatcacactttactgtattcgtattggcttgtgtggtcggatattacgttgtatggaatgtaagtcatgcattacatacaccattaatggcagttactaatgcgatttcaggcattatcattgtaggagcattattgcaaattgcacaaggaaatttctttatcagtttgttggcgttcattgctattttggttgcggcaattaatatttttggtggctttaaagtgactcaacgtatgcttgccatgtttagaaaaggttaaggagaggatgcaatgtctgaaggtttagtacaggctgcctatattgttgcagcattactgttcattatgagtttagcaggtctttctaaacatgaaactgctaaagccggttgttggtatggcattgttggtatggcaattgcacttgttgctaccatttttggaccatattcacaaggattattctggattattattgcaatggcagtcggagccgtcattggtattcaacgtgcaatgaaggttgaaatgaccgaaatgccggaattggttgcaattttacatagttttgttggtttggcggctgtattggtcggttttaatagtttcggtttacatgaaaccgcacaatttctggtaccggaaggtgttgaatatgtcacggacgctgctcaaacattattagcacaacaaaaagcggactttgttgcggaacaatctgtattggcaactattcacaatgttgaggtctttttaggtatcttcattggtgcggtaacatttaccggttctattgtcgcattcggtaaattacgcggtattattaattctaaagcgttaatgttgcctcatcgccataaattgaatttggcggcattgattatttctgcgttgttgatggtcgcatttttaaattcacctgataatatcttccctgtattactaatgacagcgattgcacttgcatttggttggcatcttgttgcttcaataggcggtgcagatatgccggttgtcgtatccatgttgaactcttattcaggttgggcggctgcagcggcaggcttcatgttaaataatgatttgctcatcgttaccggtgcattagtaggttcatcaggggcaattttgtcatacattatgtgtaaagcaatgaaccgctcttttatcagtgtcattgccggtggattcggtaatgatgtagttgcttcatcagaggcagaacaaggtgaacatcgtgaaacaacagccgaagaagtggcggaaatgttgaaaaatgcaagctctgttattattacaccgggatatggtatggcagtggctcaagcacaatatccggttgcggaaattacagcaaaattgcgtgaacgtggtgtgaatgttcgctttggtattcaccctgtagccggaagattgccagggcatatgaacgtattgcttgcagaagcgaaagtgccttatgatgttgtacttgaaatggatgaaatcaatgaggattttgcggataccgatgtcgtattagtcattggtgcaaatgatacagtgaaccctgccgccatggatgatccgaatagtccaattgcaggcatgccagttctagaagtttggaaagcggctaatgttgtcgtattcaaacgctctatggcggtaggatatgctggtgtacaaaatccgttgttctttaaagaaaatacccaaatgctttttggtgatgcaaaagagcgagtagaagatattttgaaagcgttataacaagagaaaaactggtatagaatataactgcactttgctaaaataaagtgcagttatttttttacatttaggaatatgttatggtgcaatatgccttgctcattttgtttagccttgcttcaataatttttattattaactcccattatcgttggacatatttttttgcaataagtcaatttttgttatttattggcattatgtttactattacagggcaatggcaaagagcggttaatttttcttctacattattcattgtttttgtgttgtttcatcgaattaaaatccatttttataagcaaccgcttttgatttcagatttctttttagtcatagattggcgaaattgggaaaccttgttgcattatcgtcaggctttttttgctattatggggctattggttttgttggcttatggtatattcggttggcaaaatacccccgctcttcctttttattggcagataatatcaggcttaatttctattattttaattgtttcaatttgtcattgtacaaagaacaagcaagctatcaaacaatggttagattctttacctgatgatggaagagatgtatttcttaatttacctatgtcctgtcgaggaatcttttataaatcgccagtattttctggaggtagtcaatattttcttgaaaaagcagaagcaattgaaagccataaacaatcaaattcggagcaaaaagcagatattgtagtttggttacaagaatcaacgttaaatccgcatagttttctttttaaacagcacaatattccacctatcacaatgtatgaaaatcaagatgatacaaaatgtaattctcatctgcgagtacataccttaggtggtgcaacttggaaatcagaatttgcatttttatcaggattgccctcaacagattttggtgcaatggctaatgcagtattttattctgtcgttcctcatctaaaatacagttttgttaaaaatttaaaagcacaaggatattattgtgttgctctatctccttttactaaaggaaactataatgcgaaatctgcctatgatcattttggttttgatttaatgttacaaccgcaagatttgggttatccggctcccttaagtaagaatttatggacaatcggtagtgatgaaatgagtcagtatgttcagaaaattcttgataaaaaagatgtgcctcaactaaaagatttacaaaaacccttatttgtttatgtattaacaatgcgtgaacatggtccttattacaactgcggtaatatttttcaaattcaaatggattgtgcaacggagcgagggatcggggaattaaatgattatattcaacggattgtaaatttgaatcaagttatggaagattttaatctttatatgcaacggagaaataagccttatattttaggttattttggcgatcatcaaatttcaataaaagaagctgtaccaagttacagttttaattatccttatccggaatatatcacgcaatttgcggttcgcagtaatttagaaacggattttgaaaagcacgattttttagatttagcatttatagcaggagctattttagaaatagcgggattgcctgtcgatgaatttatgcaaacaaatattaaaatgagaaaattaagtggaggtaagttacaggactgtactgatcaacaattattagagtcttatcgccattatatttattcagaattaaaagtagcggagtagttcattatgaatatgttgcctaattaaaggcgttgctgttaaaaggtataatgaaaaatggttgctaataatatctttctgaagttattagcaactctttttatttaaaagtccttattgacgtcctcccctagctaaagcaaggagattcctaccagctcccattgcaagcaatgggctactctcggaggtttctgctgctgaccgccaatgcgattcacttcacagacgctacgggcacgtcctgccctgattatgccgtcattgagagtctaaagcgacctctgttagcagtaagaagtatatcatatttgtgccttatatctacgccctaaaggacgtggttttacggcactgtctgataaaaactattttttcttcgcatatttcaaggaatcaattgcaacggcaaagataataattgaacctttgataatatattgccaatatggatttacaccaatataggttaaaccatagttgatgacagtaaaaattaatacaccggttactacgcctagtacagtaccaacaccgcctgcaaaagatacaccgcctacaacgcaagctgcaatggcatcaagttcatacataaaacctagattgttggtggcagaaccgatacgtcccgcttctaacatccccccgaaagcgtagaatatacctgcaatcatgtaaatgacgacaaggttacgagtaacgttaacacccgatacttttgctgcttccggattaccaccgatagcgaaaatgtttttaccgaaacgtgttttattccatagtacccatacaaagaaagaagccaaagctgcatagattgtaatataggaaagcttgaaagaacctatacggaaaaagccttgagcaaatgtagagaaactttcgttgaaccctgcgataggtgaagaaccgacagcatcataatagagagagttaataccgtaaacgataatcatcgttcccatcgtggcgatgaaaggtgtgacatttaagaacgcaattacaaccccatttaccaatccaattattgccccaatcatacagactactatgattacaacaggaataggaatttcaccaagttcagggaaaactctatttatattatccattgcttgtaacagagttgccgaaataactgcagctagaccgacttgacgacccgctgacaagtctgttccttgtgtaactaataaacctgcaacgcctaaggcaataattaagcgaacggaggattgcgttaaaatattactaaagtttcttaaacttaagaaacttgagtcttgcataataataattccgagtaagatcaataacacaaaataaattgcgttttgtttaaggaaatctagcgatttgttttgttttaaagcagacataattcatttccttcctttaaagatattttgccgcaagttgtaaaatttcttcttgcgatgttttagctgtttcaacaatttcagtaacttttccgttactcataactaaaatacggtctgtcactcccaataattccggcatttctgaggaaattagaatgatccctttatctttttttgccaattccatgattagctgataaatctcgtatttggcaccaatatcaatgcctcgggtcggttcatcaagcatcaaaatttcaggttgtgtgagcaaccaacgcccaataattactttttgctgatttcctccagaaagtgagccaatatgggtttgatgtgaaggggttttgacattcattgcatcaataacccattgggtatcacttttcattttaatggactttaataaaccaaaatgacctaaataggatttcatattagaaatgagagagttaaattctatgctcagatttgcataaatacctgttgagcgacgttcttcggtaacgagagcaaatccattattaatcgcctcaagtgcggtgcgatttttcatttctttgttatacaatttaattgttccacttttacgctcacgaataccgaaaatggtttctacaatatccgtacgtttggcaccaacaagtccagcaataccaagaatttcacctttacgcaattcaaaagaaacatcttgaatggagggttgatttaatgctgtcagatttttgacttcgagaataacttctttgggttgatttgttttaggggggaagcgttgagttagttctcttcccaccatcatggaaactatttcatccatggtagttttttgtacttcaacagtattaatccatttaccgtcacgcaaaattgtgatttcatcacaaattttgaaaatttcatccattttgtgtgaaatataaacgattccacagccacgtttttttagttttgcaatgattttgaataaatgttcaacttctttttctgaaagtgaggaggttggttcatccataatcacaattttggcattgtaggaaaaggcttttgcaatttcaaccatctgcatttgtgatacagataaattcgctactttctctttgggatcaatatcaatacctaactcatcaaaaatagcttttgtatctcgatacatttttccgtgatcaacaaaaatgcctttcaatggataacgtcctagccataggttatccatcacattacgttgacgcaccaaatttaattcttggtgaaccatggatataccgttttccaacgcctcttttgaggttttgaaattaattggcttgtttaaaaaaagaatatcgccttcatctttagcataaataccgaataagcatttcaacagtgttgatttacctgctccattttctcccattaacgcatggactgagtgagatcgaattgttaaattcgctttatcaagtgcttttacgccgggaaaggatttactgacatttatcattgtaagcaatatttcgctactttgatgtagagtttgtcctgtcatatccaacctcatagaaaaggggagtacatatctcccctaatgattacaacaattattttaagaattcatttaagttgtctttatcaatgccgacataaggaatacgaacaacacgtttttctaatttccagtttgttccttctgttgcaggtttaccttgtgctaaattttttgcaagttgaaccactgctttaccttggttaacaccatcatttagtacggtacctgccatttcacctttcttaattaactgtaatacttccggcaaggcatcgacaccgaaaatcgggagttttttaccatgggctttagttgcttccaatgcacccattgccataccgtcattattagaaataataacctcaatttcgtttgctttagagctggataaccaagcatccactttatcttttgccattgcagcatcccacataccagtatcaatgaacaattgttctgattgaataccctgagcattgagtgcttcaattacgtatttggtacgagcttcagcatccggatgccccggttcacctttcaataagacatattgaattttcccatctttatttaagtcataggctggatttgctttccaatgtttcgcaattaaattaccttgaatgagtccggattctttaggatccgtaccgacatagtaagcgtggttatagcttccaattgcttttgctccgggatctttattgaagaagataactggaatatcctccgattttgcttttttaatgacagttggtgcagcggcagggtcaacaaggtttattgctaatgttttaatgcccttggaaattaatacatcaacctgatcattttgaacagattgtgcattttgtgaatcattcattaacaactctaatccacctacagcttttgcttctttatcgatttcttgacgcattaacgccataaaattatcgtcgtatttgtaaatggttacaccgatacgatcagctgattgtgctgagattgcactaaaacctacagctaaagttaccgcacttaatattgtttttttcataaaatgctccttgattggactggaaaatagatattcttatcgatacttagcctatggtttggcaagccacgacaaggatagccgaaaatgtgtgacaagactgtgatctgtttcacatttatagaaatttatgaaaacgatttcataaaataggaaaattaaggacgttcaactgaaaagcgtcgaactaaagttggattaaattggatatgaacaggttcatcaatttgattgtctactagacttagtgcgagttttgccgcataagttgccattaaatcaataggatagcgtacagtagtcagcttaggaattaaatagcgtgaaatgggcatatcatcaaatccaataatagagaattgtttaggaacttgtatattattttcgttcaatacggaaatagcaccagcagccatactgtcgttatacgcaataactgcggttaaatttgagttataactcaataaattaatcatcgcattttcacctccttcaaaatcaggtgtgctacgtgcaattgcatgttcaacagcgtgaagtttatgatgttctaatgctttcaaatagccattaaaacgatcattttcatctgtaatttgatgatttgagccaatatagccaatatgctgatacccaaatttgatcagcatttctgtagccagaaaggtacctttattattgtctaaacttacacaacgagtttcataaccttgaatgacacggttgatgattaccataccggaaatacgttctaaatattgagcaagctcttgatcacttaaagcttttgaatgaacaactgcatcgtttgcacaataaggtgtctattgcatttctttctttttccgcattgtgatagccaatgccgattaagatacttttttcatgttcttccgcaacgttatctacggctttaactaaaattgcaaagaaaggatcggttacatcagtaacaacaacgccgatagtatctgtatgttgtaaggcaagagcttgagcattggcatttggatgataatttaatttttcgaccgcactttgaaccgctaggcgtgcttttttactggcagaaggatgattattgagtacccgagaaactgtcgcaacagaaactcccgcttgtctagctacgtcatgaattgtaatcatcttattcacccatacggtttaaaatttgcatgaattgccacttatcataaccaaataaattatgtttggaaacggttgttaaactaaaataaaagctacttcacaaaattattatttatctcaatatttataatttaataattgtgatatggatcacagttaaacaaaatagcgatgtgatagcatagctgaaaattatttgtaatcgtttacatttttgcgataaatatcaagtttgagggtataaaagtgagtgaaatgaccgaatttgttgcgacagaacatccgcatcgtcgttataatcctttgacggaacaatgggttttagtctctccgcatcgagctaagcgaccttggcagggacaacaggaaaaaatagctgatgaaaataaaccttgttacgattccgcttgttatctttgtccggggaataagcgtattaccggtgagcaaaatccgaattatacgaaaccttttgtgtttaaaaatgatttttccgctttattagaagatacgcctgaaccactaaaaacggatgaccctttatttcaatccagtctagcacgtggcgaaagcagggtagtttgtttttctccggatcatagtaagacgttgccgttattaacggtagaggaaatttttgcagtggtaaaagtttggcaagaacagctggaggagcttggtaaaaaatatcaatgggtacaaatttttgagaataaaggtgcggttatgggctgctctaatccgcatccacatggacaaatttgggcaaatagttttttgcctaatgaagttgctcggacagacaaggcacaacgaaattacttcaataaacaaggttcgattttgttaatggattaccaaaaacgtgaacgagatttgcaggaaagagtagtaattgaaacggaatattgggttgcagttgtgccttattgggcggtttggccatttgaaatattgttactacccaaaattcacgtgaagcgattaattgatctgaatgagacgcaggcaaaggatcttgccttggcattaaaaatgatcacaaccaaatatgataatttgtttgaaacttcttttccttattctatggggttccattttgcaccttttaatggtgaaaagaatgaacattggcaacttcatgcacatttttatccaccgctactccgttcggcaacggtgcgtaaatttatggtcggttatgaaatgttaggggaaagtcagcgagatttaaccgctgaacaggctgcagcaaggttgcgtgaattaagcgatgttcattataaaaataaataaatttaacggagtgataatatgactcaacaaaatccaaaacagcgagcgaaacagttatttagtgaaaaatttaaccgcacttctgaactgaatgtctatgcccccggacgagtaaatattattggtgaacacacggattataatgatggatttgtgatgccttgtgcaattaattatggaacggcgatcagcggagcaaaacgagatgattatttattttgtgtatatgcggcagatttacaagaatatgatgaatttgatttaactcgacctattgaacccaaaatggaagctaaatggacaggttatgttcgaggtatggtgaaatttattcaacaacattgccctgattttcaacaaggtgcggatttggttatttgtggaaatgtgccactttctgccggattaagttcttctgcatctttagaaattgctgtaggtaaattttgtcagcaactagcggacttatctttaacaaatatagaaattgcattaataggtcagcaggcagagaataaatttgtaggtgcaaattgtggaaatatggatcaattaatttccgcattgggtcaaaaagatcattttctcatgattgactgtcgatctttagatattgttaccatacctgttcctgaaaatattgttgtgatgattgtgaattctcatgtgaaacatgatttagtaaatggcgaatataatatacgccgtcgacaatgtgaaatggcagcccaattttttggcgtgaaagccttacgtgatgtatctgtggagttgttcaaacaaaaggaagcagaattaaccgctcttgatcctgaaatagcgaaacgtgccaaacatgttgtgacggaaaatgagcgggttttacaatcagttcaggccttacaacagggagatttgcaaaaattaggggaattaatgtatcaatctcatgattccatgcgtgatgattttgaaattactgtgcctgaaattgattatttagtggagttggcacaggtcgttatcggcaaaaatggtggagcacgcatgaccggcggaggttttggcggttgtatcgtcgctattgcaccgcaagacaaagtggaggcagtacgtcaaattattgcagacaactatgaaaaacaaacaggtttgaaagaagatttttatgtttgtaccgcttctaaaggagtgacgatatgctaattgattgttttgagaaggaacacaagcaaggaatggcaccggatggacaaccttttcgtatttttacgttaactaatacaaaaggcatgaaagtgcaagtgatggattggggggcaacttggatttcttgtcaagtaccggtaggaaaagaagtacgagaagttttgcttgggtgtcagattaatgattatccgatacaacaggtttatttaggagcgagtattgggcgttatgcaaatcgtattgcaaatagccgatttgagttgaatggtaaacgctatttacttaacgctaatcaacatcagcatcaacttcatggtggaaaagggtttcataatgagcgttggtatttagaaaagtgcggtgtaaattccatcactttttctcattttagccctgatggagatcagggatttcccggtaatttacatgcttttgttacttattctttaagtgaaaccaacaacgtgagaattgaatatgaggcaatttgtgatcaagattgcccaattaatttgactaaccatgcttattttaacttgaatgatgctactttcggttgtgatattcgagggcattctttacaacttaatagcgattattttttgccggtggacagtgcgggtattcctaatgctaagttaaaagcggttgagggaactagttttgattttcgtgaggaaaaaccgatcggtttagattttttacaagaagaacaaaaattggtaaaaggttacgaccattctttcttgcttaatccggacactgaaaaaccttgtgctattttgaccgcacttgatcgttctttgagaatgcaagtgttgacttctcagccggctttacagatttatacgggcaattttctatcagctacgccaactcgtcaaaacgggcagtatgctgattatgctggtattgctttggaaactcaatgtttgcctgatacaccgaatcatccggaatggtggaaatatggtggaataacaaaggtgggtgaaaaatattctcataaaacggaatatcaatttatccgttagatttttaagcaaactctattgaaattaagggggagtattcaaaaaactcccttatttttttctatttctcgcttatatttttgttatgtcatacttttcctgatttttcctagttattcgttacaaaatatgataattttcatgggtcaataagacggaaacaatattacagtttatgagtaacgacgaacagattaatacaatcacagaaaatgaaagtaagaaaaatttctttcactctttatttggacgcttttttcagggtgaattgaaaaatcgtcaagaattagtagacgttatccgagattctgaacaaaatgagctcattgatcaaaatacacgtgaaatgattgaaggtgttatcgaaatctcagaattaagagttcgagatattatgatcccacgttcacagattatttttatcgaaaatgatcaggatcttgaagcgtgtcttgatgttattattgcaagtgcacattctcgtttcccggttatcagtgatgagagagataatattgccggtattttacatgcaaaagatttacttaaattttttcggtctaatgcggagcaattcgaattacaaagtttattacgacctgccgttattgtaccggaaagtaagcgtgtggatcgaatgttaaaagattttcgtgctgaacgttttcatatggcactagttgttgatgaattcggtgcgatttcaggtttagttaccatagaagatattttggaacaaatagtgggggatattgaagatgaatttgatgaggaagatgtggcggatattcgtcagttgtctcgtcatacttatgtagtacgagctttgacggatattgatgattttaatgagcaatttaagaccaattttgccgatgaagaagtggatactatcggaggtttgattatgcaagcattcggctatttaccgaaacgtggtgaagaagttgtactggataatttgaattttaaagttacttcggcagatagtcgtcgtattattcaagtacgagttactgtgccggatgagcaacttacagacagtaaaaaacagaatacagaagaatgagaaattaccttgtttatttcattgctattttaactgggggagtgggcgtattagccttttccccttttgatctttgggcaatcgcctatctttcattagcagggttgatttggattgctaaaaaatcgcaaaaaaagaccgcacttctagccagttttttatggggtttaagtttctttgggattggcgttaattggctcaatgtcagtatttatcaatttggcggaacaccgttaattgtgagctatttactggtcattttactggcaggatatttggcactttatcctgtgttgtttacttatttagtacaacgttttagggtacaaagtttagcgatatttcctgcaatttggacattgactgaatccttacgcagttgggtatttactggttttccttggctacaatttggctatactcaacttgacagcccatttgcgaacttagccgctttgttcggtgtagaagggctgacttttttcgtgatgtggataagtgcggtcatttttagtcttatttctcagctcatacaatcaaagaaacaatgggcaattattattacacatagtgtattgcttgttgtgatgttagggctaagtgcatccactgcgttacttaaatttacacaagaaaatccacaaaaatccctaaatgttactttagtgcaaggaaatattgaacagcaactaaaatgggatcctgattatttttatcaaacactcactatttaccaacgcttaattaaccggagtttagatgactcagatttaattatattgccggaagctgccttgccggccttggaaaatcacattcaaccttatttgcaaaccttacagcaacttgctcaagaaaaaggcgttgaggttgtaattggaacgatttatcaagaggaaagtgaggataaattattaaattctatcgtaaatctcggtaacgctgatgaaccttatcatctaaacacaaaaaaccgttatgcaaaacaccatttagttccttttggagaatatgtccctttagacaaaatattacgcccgttaggttcagtttttaacttgcctatgtcaagttttgcgtcaggagactttgtccaaaaaccatttttagcgaaaaatcgccattttactccggcaatttgctatgaaattatttttggttctcaactacaacaaaatttaactaagcaaagtgattttattttaactatctcaaatgatgcttggtttggcgatagtataggcccttggcaacacttgcaaatggcaagaatgagggcgattgaactgggaagacctgttattcgtgcaactaatactggtattacagcctttattgatgcacaaggtaaaatagttgcacaagctccgcaatttactgaaacgacactgagacataaaatcgttgcaacggaaggtatgactccctatgcaatattaggaactaagccgttgtatttgttaatcagtttattagtattatttagaagtctaggtgcattgatacgcaaaaaattgacgcaaggatagaaaaatattattttgcgaacaggttacagctatttttccagattgtagatgcgataagttctgccggttcttttcttaattgacataattcatggaaaacatgaataattcgctctgaacgattgggttgaccttgaaaaccacaaatgggcatatcgggactatccgtttccagtaataaactgtctaaaggtaattttgcaatagtgtttctggttttattggcacgttcataggtgattgtgccgccaacaccgattttatagcctaaatccacaaaacgctttgcttgatcataacttccggcaaaaccatgaattacaccgcacttatttacttttattcgtttcagaaaagtgaataagtggtcgtgagattggcgactgtgcaagctgacaggcaaattaaagcgttgtgcaaaactgagttgaacttctagaaattcacattgctttttccataatttctcgctaatcagatccgattttcctcgttccagacctatttcagcaattgctgtacaagcagcagaaccttgttctaacgcttgggacaaaatatctaaatcatttttactatgctgttcaatatataaaggatgtaagcctaatccataatacagctgagtcgggtaaagtgcggtcatgtttacaatattttcaaaatctcgctgcaatactgctacaatcagtattttctctacatcaacttggcgggcattatgtacgagttgagccaaattttcctgagtaacttgctgtacataatctaggtgtgtatgggtatcgaaaaaatgcataatgatttgatgctggcaatttgaggaacaatattggctacattacgacgaaatccttgatcgactttttgttgaatgatcaaggaaatcgttatctacaagatgggtaaaaattgtaatatgcttgaatgtaacaccgcactttttgatgaaaatgtaccgacaatatttgtcggtccactatcaaaaatattattcaatggtaacagaagtaataattacatcttcaacaggcacatcttgatggaaacttttgtttcctgttttgacacctttaattttatcgacaatatccattccttcaacgacttcaccaaatacagcatagccccattcttgcacaacggttttaccaaacatttcttttgctcgataatcaaggaatgtgttgtctgctacattgatgaaaaattgagctgtcgccgaatgaggatccgatgttcttgccatggcaattgtgccacgtttattgctaagtccattacttgcttcgtttttaattggtgctttagtatttttttcacgcaagccactttccataccaccaccttggatcataaatccatcaataacacggtggaaaattgtgttattatagaacccctctttgcaatatgttagaaagttttccgctgtaattggtgctttttcaaaatttaatgctaatttaatatcaccaaaatttgtgtgtaatgtaatcattttagatcctttgattttgtgttgttataatgatgcttattatttcataaagttgcaataagtgctataaaatcatcactgagcggattcagcgttctggtagattaacgatttcatttaattatagagaacaaacaaatgttaaaaatttttaataccttaacacgagaaaaagaagtgtttaaacctatttcagaaaataaagtaggaatgtatgtctgtggtgtaactgtatatgatttgtgtcatattggacatggacgcacttttgtttgttttgatgttatcgctcgttatttacgttatttaggttatgaattgacttatgtgcgtaatattaccgatgttgatgacaaaattattcgccgctctttagaaaatagagaaacttgcgagcaattggtagatcgtatggttgttgaaatgtataaggattttgatgcgttgaatgtattacgtccggattttgagcctagagcaacacaccatattgcagaaattattgcactggttgaaaaattaattgcacgtggtcatgcttatgtggcggataatggtgacgttatgtttgacgtggaaagtttcaaagagtatggcaaattatctcgtcaagatttaacacaattgcaagcgggagcaagggttgaaatttctgaaattaagaaaaatccaatggatttcgtgttatggaagatgtcgaaagaaaacgaacccagctggaattcgccatggggagccggtcgccccggttggcatatagaatgttccgcaatgaattgtaaacacttaggtgagcattttgatattcatggtggtggatctgacttaatgtttcctcatcatgaaaatgaaatcgcacaatcttgttgtgcacatggaaaccggtatgttaattactggatacattcaggtatgatcatggtggacaaagagaaaatgtctaaatcgttgggcaacttttttactattcgtgatgtgctaaaccattatgatgcggaaagtgtccgttatttcttgttgacagcccattatcgtagccaattgaattatagtgaagaaaatttggatttggcacatggtgcattggagcggctatacactgctttgcgtggcacagataaaagtgcggttgctttcggaggggaaaatttcattgctcagtttactgaagctatgaacgatgattttaatacgccgaatgctatttctgttttatttgaaatggctcgtgaaattaatcgattaaaaaatgaagataaactgcttgccgatggcttggcggctcgtttgagagaattagccggtattctaggtttattggaacaagatccggaagattttctacaagcaggctcggatgatgctgaaattgctaaaatagaagaattgatcaagcaacgtaacgatgctcgtcaggcaaaagattgggcgagagctgatgctgcgagaaatgaattgacggcaatgggcgttattttagaagacggttcaaacggaaccatgtggcgaaaaatgtagtgattgaaaggggcgatattctcgcccattttgatacgttacggttagattttacttatcagcagaataatataatttaccaatctcaattttctgacgaccatttgcttcacgccatttgtttgtatctcgtaaagaatagacgcaaccgcagtattcttgttggtaaaaacgttctcgtttactgatttcaatcattcgttgcgaccctccgcctttacgccaattgtaatcccaataaaccacatcatcatatttttccgctgcacgatgtccacaaccattaatttggttcatatctttccaacgagaaattcctaagcaactggtaaaaacagggaaaccattttcatgggcatactgtgcggctttttcaaaacgcatatcaaagcacattgtacaacgaataccccgttccggttcatcttccattccttttgcacgatcaaaccaattttgacgatcataatctgcatcaatgaaaggaattccccatttctcggcgaagcgaatattttcttctttacgaattaaatattcttttaacggatgaatattgggattataaaagtaaattgtaaaatcaatgcctgaagcatgaatagcttccatgacttctccggagcaaggtgcacaacaagaatgtaataacagtttattatgtccatgtggtaattctaatttggggcgtacgaaaggtgtattcgaatttttacattctttcttacgacgcttttgtgcatcaaagtgcggttgcttttgttcaagtttggttctgtgcatatctattttcataaggcttgtttgataacgattaaatttaggggaataaatgtttaatttccccactcaagtctaaaaggtttttcattcaaatctgataagtatttttactacaatactcaatgtctaatcattaatagtgcctctcaacggataaataagccaaagaaattaatgcttgcttatattggttttctggtaaacaggaaattgaatcaacagctttttgagcctcttcttttgctttactcatggcataatccaaagatttttgttctgtcataatggcaagtacatcctccaaaaaatcccgttttccgccctgttcgattgcttcacgaattaatgcagattgttgtggtgtaccattacgcattgcatgtaataaaggaagagtaggtttcccttcagctaagtcatcaccgatatttttacccaaagtcgccgcatttgcactgtaatctaacacatcatcaactagttgaaatgctgttcctaagtatcgtccatagtgttgtaaagcaatttcttgttctgcattactttgagctgttatggcggcacattgtgtagcgacctcaaacaagcgagcggttttactataaatcactttcatataattatcttcacttgtctccggatcattgacattcattaattgttgtacttcaccttctgcaatgatatttgttgcatcggacataatttgtaaaatacgtaatgaattgagtttagtcatcaattggaatgcacgtgtataaataaaatcacctaccaatacacttgccgcattgccgaattccgcattggctgtcggatttccacgacgcatatcggactcatcaacgacatcatcatgtaacaatgtcgccgtatgaataaattcaacaaatgcagcacaagtaataggctcatcaccttgataatttagtgctctggctgccaacaaagcaatcatagggcggatgcgttttccaccactttgaacaatgtaataaccaagttgattaatcaaagcaacatccgaattaagttgtgctagaattgtggcattcactttatccatatctgttttaataagagattggattgcattgatattcattgggttcattttttctatcatgctgaaactatcataaattaagctaaaagtgcggttgattgtacctgattttctgagctttctgaaattaaactctataaaataagatttttttattttcttaaaaagaaaggcttgcgaagaagctgtttttttcgtagaattcgcagcctatttatatgaattttgatgtgctaaatgaaaataacattataagcactattatctagcggagtatttatgtacgcagtttttcaaagtggcggtaaacagcaccgtgtaagcgaaggtcatgttgttcgtttagaaaaacttgaattggcaacgggctctactgttgagttcgattcagtattgatgatcgttaacggcgaagatattaagatcggtacaccagtagtgacaggtgctaaggtagtggctgaagttgtgtcgcagggacgtggcgaaaaagttaaaatcgttaaattccgtcgtcgtaaacacagtcgtaaacaacaaggtcatcgtcagtggttcacagaagtgaaaatcactgggattcaagcataatttcacaggagttatagaatatggcaactaaaaaagctggtggttcaactcgtaacggtcgtgattctgaagctaaacgtcttggtgtgaaacgtttcggtggcgaatcagtattagcaggtagtattattgttcgtcagcgtggtactaaattccatgcgggttcaaatgtaggtatgggtaaagatcatactttgttcgctactgctgatggtaaagtaaaatttgaagttaaaggcgagaaaagtcgtaaatacgtttctgttgtagccgaataattttattgatacagagtgatgccccacaatgtttttgtggggttttttgtttttagaaaattaatactttattagcacagttaccagtgcggtgctattattgcacgagttttgtatttatataggagggcgaatatgaaacagaaaccattactcgggtttatatttgcattgactactgcgatagcttggggatctttacctattgcattacaacaagttatgaatgctatgagtatgcaaactatcgtttggttcaggtttatggttgctactgttgcattagctattttacttaaattagcgaacagattacctaaattatcagatctcaatcgttacttttttggactggttatattaggtgttatagggctatccggaaactttagtctgtttaattcctcattaaaatttattgagccttctgttactcaaatttttgtgcatttttcttcctttgcaatgatgttctgtggagttgtgatctttaaagaaaggttaggattacatcaaaaaattggtttagttattctaattattggacttatcttatttttcaatgagcgagcggaccaattatttgatattaatatctattctataggcgtatttttaagtatgtcggcatccttgatttgggtaacttacggactcgcacaaaaattacttttacgccgttttaactctcaacagattttattgatgatttatacagggtgtgcatttgtttttactccttttgttgagattgagcaattgcaaaatctaaatacttttacgctaatttgttttatttattgttgtctgaatacactaataggttatggtgcctatgctgaggcattaaaccattgggatgttgccaaagtaagtgttgtcattaccttggtacctttgttcactattttatttgctcacttattaaatttaatatacccacagtatttttcagcccctgaattaaatacgctcagctatattggtgcgttcattgttgtctttggtgcaatgacctcagctattggttataaatttatcaagaataaaatttaggagaaaaaaatgaaatttattgatgaggcactgattcgtatcgaagctggtgatggcggtaacggctgtgtaagttttcggcgagagaaatttattccgaaaggtggtcctgatggcggtgatggcggtgatggtggcgatgtatatctaattgccgacgagaatttaaatacattgattgattaccgatttgaaaaacgctttgcagcagagcgtggagagaatgggcgtagttctgattgtacaggacgtagaggcaaagatattacattaagggtaccggtcggaacaagagcaattgataacgataccaaagaagtgttgggtgatttaactaaacatggtaccaaaatgttagttgcaaaaggtggttatcatggactggggaatgcacgtttcaaatcttcagtgaacagagcaccaagacagaaaaccaatggaacaccgggtgaaaagcgagatttgcaattggaattaatgcttttagccgatgttggtatgttgggattacccaatgcaggaaaatcaacatttattcgagctgtttccgcagctaaaccgaaagttgcagattatccttttactacattagttcctagtttaggcgttactcgtgttgatactagccgtagctttgtgattgcagatattcccggattaattgagggagcttctgaaggtgctgggttgggagtacgatttttaaaacatttggagcgttgtcatgtcttaattcatttggttgatattgcaccaattgatgagagtgatccagcggataatattgcaatcattgaaggtgaattatttcaatatagtgaaaaattagcgaataaacctcgttggttagttttcaataaaattgatacactttcagatgaagaagcaaccgcacgtgcaaagaatattatgcaacgtttgggtggggaagatgattattacttgatttcagccgcaacaggtaaaaatgtagacgttttatgccgcaatattatggattttattgaagaaaatccacgtcaagaacaagaaaagatagatgctcaagaagtgaaatttaaatgggatgactatcatcaagaacaattgtccgaacaggtctttacagaagatgaccaagaagaggatgattggggcgattggtcggaagacgatgaggaaggtgtagaaattatttataaaccttagctacagaataaaatatgagggtttccttttttatttaaattgaatgttgatattcatattctaagtaggaaactctcagtttttgtagtaagctgtctgagcaatgctgatcttctacagatatatcaccataaaatatctacttgtttttagtgatgagcggttatttttcctacatttttttcgtaaaaaagtaaatagagaaagattgtttttttaatcagtgtttctgcatcagtaactaagatgtctcttcctctaagttattgaaatatctttgccaatcaaaatattgaccagggtctatttttctattcggagatatgtggcaatgtccgacaatacgttgtttggttattaaaggatatgaatgcataatgtctaaagtcagacgttctaaagattgatattgttcttctgtaaacggttgaagatcacttccttccaattcaatgccaatagaaaaatcattgcatttttctctcccttcaaatgaggataatccggcgtgccaagccctatcattgaaattgacatattgtgtaatagcaccatcacgagtaatcaaacagtgtgctgacactcgaatgtttgcaatagttgcaaaataagggtgtgcgagaggatcaaggttacctagaaaaaaatcatcaatatacgaaccaccgaattgctctggcggtaagctgatgtaatgaataactaaaagggaaatatcactattttccggacgttgatcaaaatgtggagagggtaattttctagcctctgaaaaccaacctgtgcagatatttttttgtttattgttcataaattattatttttgcgagtcggctcgcagaaaaagtgcggtctatttgtcggtttttttcaatttctacaaactttcacttgccattcggcattgtcattttatttaaaaaaggaaacattatgaaaataacctatattttttcatcagctaaaaaaggatttactctcatagaactgatgatcgttattgctattgtggcaattcttgcaaccattgcaattccgtcataccaaaattatacaaaaaaagctgcaattacagagctgttacaagcttctgctccttatcgtgcagaagttgagctatgcgtgtataacaatgatgcaccgacaaattgtaatgctggaacaaatggaattcaagcggcaatcaatacaccaaaaggtaaagtaaaatcagttagcgtgcaaggtggagccattactgttacagggaatggaaatcttaaagatattacttataccttaacaccaacaggcgatgcttcaaccggcgttacttggagtgcaaattgcaataataaggccgatctatttcctgccggattttgctcttctacgtctacaaactctccttaaaccattaattacggtgggttgtctcaccgtttcatattaattgcactataaaaagaatttttttgcaaaaatattgcatatttattcaaacggtgataatgtttgcgtaaatcaattaataaccaaaacgagatcttttattcaaatgacaattagtgttaaaaatttaaattttttttatggtgcatcacaggccctgtttgatattaatctcacagctgaagatggtgataccgttgttttattgggaccaagtggtgcagggaaaagcaccttgattagaacgttaaacctacttgaagttccaacatctggagaattgagtattgccaataataaattcgatctctcgcaagatattgccaacccaaagcaaatgcgtcaattgcgtcaagatgtaggtatggtatttcaacaatacaatttatggcctcatttgactgtaatggaaaatcttattgaggcaccgattaaagttttagggatagcgaaagaaaaagccaaagaacaagctattgaattattaaaacgattacgcttggaagaattcgctgaaagatttccactgcacttatcaggaggacagcaacagcgtgttgctattgctcgtgcattaatgatgaagccgcaagttttattatttgatgaaccgacagcggcattagatcctgaaattacagctcagattgtatcaatcattcaagagttacaggaaatgggcattacacaagttattgtaacgcatgaagttgcggtggcaaaaaaggttgcaaccaaagttgtctatatggaacaaggtcgcatcgttgaaatgggggattccagctgttttgaacaaccctcaacagagcaatttaaacaatatttatctcactcacactaatatttaaggagcttattatgaaaaaattacttttagcaacaatgttggcaggtgctacgattggtgcaaatgcacaagatattacttttgctatggaaccaagttatccaccatttgaattaactaatgaaaaaggtgaaattattggttttgacgttgatattgctaacgcaatttgtaaagaaattcaagctaattgtagcttcaaagcccaagcgtttgatgcgttaattccaagtttaattaaaggtcgcggtgggtttgatgcggcaatttcagcgattgatattacggaagcccgtgcaaaacaagtagcatttaccgattcttattatgaaagttctgccagttttattgcattaaaagggaaagcggatttaacgacggcaaaagtggttggtgtacaaaacggtacaacgtatcaacaatatgcgaataaagaagcgaagcaatatcaatctaaatcttatgccagcttacaagatgcaattttggatttaaaaaatggtcgtattgatctcatttttggtgatacggatgtattaagagatatgtttgataaaaatccggaattgcagtttgtgggcgagcgtgtaacggataaacgttatttcaataacggcttgggaattgcggtaaataaaaagaataccgcacttgttgagcaattaaataaaggtatttcggcaatcaaagcaaacggcgaatatcaaaaaatttatgataaatggatgactaaataattttatgtttattgattatttacctttaatgtataccgcaaccctgatgaccttagggttggcggtttgttctttattactcggattggcattatctattttctttgtagtattagaaacacacaaatgggcatgtattcgtaaaccgacagccactattgtgacattattacgagggttacctgaaattcttgtggtttttctaatttattttggcgtacctgaaatactggaatggataatcggagaatatgtagagtttggtgcctttggttgtggcgtggttgcactgtctattatttttgcttcttatgcttctcaatctttgcgtggagcaattcaggctatacctttaggacagtgggaatccggtgcagcattaggtttgagtcgtagttatacgtttatttttcttattatgccgcaagtttggcgacacgctttaccgggattgagtaatcaatggttagtgttattaaaagataccgcacttgtgtcgttaatcggtgtgcatgacttaatgcgtcaagctgaattaatcaacaccaatactcaccaaccttttacttggtatggatttgcagcattgctttatttgttgattacgctatttagtcaatttattattcgtaaacttgagcggcgagtcacacgctttgaacgtgctacaaattaaaggatgaaaaatgattaaagattattttttaacaattgcacaaggaattccaacaagcttgattcttactatagttgccttgctggtagcattttttcttgctttgacattaacttttgctctttctatggaaaaaaaatggttaagtcttccaattaatctttttctcacaatttttaccggtacaccattactggtgcaatttttcttaatctatgcaggaccgggacaattttcttggattgtaaatagttttttatggcctttattatcaagtgcgtggttttgtgcaatacttacattagctttaaatagtacagcgtattcaactcagcttttttatggtgcggtaaaagcgatctctaaaggacaatgggaaagctgtgttgcactaggtttgagccgttggcaaactttgaaaattcttgttccttacgcattaaaaagagcattaccttcatatagcaatgaaataattcttgtttttaaaggcacatcgcttgcttcaattatcactattttggatattatggggtatgcaagacaactttatggtactgaatatgatgcactgacaatttatggtatcgcaggcgtaatctatctcattattacaggtattgctactttattattacgcagattggagcgtaaggtgcttgtatttgagcgtttagaaacggagcgagtgtaaatacacaataacaaataccgaaaagtgatctgtgccttaatttatcgtttatgagttatctatttaagatttaaggaacagatcaatatcggtaatcaccaattgctatttcgtatgaagttttgccaatccgatatcacaacttttgatttgtatatcatgctccatggcgagaatttgttgcttactttgttttaatttactttttatttttgccagttgaacatgtgttcccggctgtttttctgcctcagcaattagattttctgtttctttaaataatttttggcactgctcaggcagagtgtttgcttggacatgagttgttgttatagttgcaaatacgctagctaaaataatcattactgatcttggttttagcattatattcattgataacctcttgaaattttttcagaaaaccttcggaaactatcaaaaaaagactgacatgtctagttatttattgcttcatatttttttgtaattttttactatttggaataaatgttaaaaattgtgaatattctataatgtttgatgtatgtcaatatataagaaagtgttaaagaaatgttatttgatttagatctaaaaatgtgatctttataacacttttattgttttttattcttacttttagtagtaaaattaataccgtttttgggttatccacatgacatttaatagtgaactgtgaaacttatgtaaattttatgttgtatgttcatttaaatgaatgtttatgaggatagttcagtaaatctacttgaggtttcaacttgagtatttgaggggtggttacatagtaatcattgtgaaaaacttgtagcattgcacaaggagttggagatgttggacgttgttgaactctctagattgcagttcgcgttaactgcgttgtatcactttttgtttgtaccgctaacattggggttgtcatttatccttgtgattatggaaactttatatgttgcaacaggcaaagaagtgtataaagatatgaccaaattctggggtaaattgtttggtattaattttgccttaggcgtgacaactgggattacaatggaattccaatttggtactaactggtcatactattctcattatgttggtgatatttttggggcaccgctcgctattgaagcattacttgcatttttcttagaatcaacatttgttggtttgtttttctttggatgggatcgtttatcaaaagctaaacatttattaactacatattgtgtagcatttggttctaacttttcggccatgtggattttagttgccaatggctggatgcaaaatccggtagcgtctgagtttaattttgaaacaatgcgtatggaaatgaccagttttatggatctttggttaaaccctgttgcacaaagtaaattcttgcatacattgtctgcgggttatgtgactagtgcatgttttgttttagctattagttcatattacctcctaaaaagacgtgatgtcggattcgcaaaacgctctttctctattgcatcagttttcggtatcattgcaactgtttcagtattgatcatgggtgatgaatctggttacgaaattggtcaaacccaacctgtaaaattagctgctatggaaggtgaatggcatactcaaccggctcctgcgtcttggaatatgattgttgtacctaatcaggcagagcaaaaaaatgattttgctttacaaattccttatgctgcggggattattgttactcgctcattagacaaacaatttacaggactagttgatctacaagctcttaatgagcaacgagttcgtaacggtatggttgcctatggtttactacaacaattgaaggctgagaaaaaggccaacggtcaggttaatgaagaaactaaagcacaatttaacgcagttaaagatgacttaggatttggtctattactcaagcgttatactgatgcggtcgtagatgcaactgatgagcaagttaagcaagcagctgctgatactatcccaaatgtaggaccaacgttttggtcattccgtataatgatgcttgccggtggtttaattctagttctgatgattgctgcattcgtacaaaatatgcgtaaaacagtagggcgtagtccacttttattaaaagctttattatgggggcttccacttccatggattgctatggaaagtggttggttcttagctgaatatggacgtcaaccttgggctatttatgatgtactaccggttggtgtggctgcgtcaaatttaacaacagctgatctttggttatctattggactgatttgtgccctctatacaatcttcctagtagtagaaatgtatttgatgtttaaatatggtcgcttgggtccgagttcgttaaaaaccggtcgttattattttgaacaattatctaaataagcaggagtctaaccatgattgattatgaatttctacgttttatttggtggattttagtcggggtactgcttattggatttgcagtaacagacggatttgatatgggagttcttagcttattacctttcgcaggcaaaaaagaagttgagaaacgtataatgatcaattctatcgcaccacattgggatggaaaccaagtttggttattgactgcaggcggtgcaatgtttgctgcttggccgatagtttatgcagcctctttctccggcttttatgttgcgatgattttagttttagccgcactatttttccgtcctgtcgggctagagtatcgtgctaaaattgataatccaacttggcgtaaattttgggattggggattatttgctggtggttttgtcccatcattggtattcggtgttgcattcggtaatttattgcaaggtgttccatttgaatttaatgatttgatgcaagtaacttatacaggttctttctttgaattattaaatccttttgcgattctttgtggtttaatcagtttttctatgttaaccacacaaggtgctgcttggttacaaatgaaaacaacatcagaactgcgtgagcgtgctcgtgtaataacacaagtaggtgcttttgttacattgttgacgtttattttggctggtgtttggttatatttcaaagaaggctttattgtaacaagtgtccttgatcataatgcaccatctgacccaactgttaaaacagttgcagttgaagtgggagcttggtttaagaattattttgatgcacctgtgttgtttattcttccagcattagcagtgggtggtgcgttgttaaatattctggcatcaaaagccaaccgttcaggatttgcatttttcttctcgtctatcacgatggcaggaattatattaacctgcggtgttgccatgttcccatttgtgatgccttctatttctcatccgaatatgagtttattaatgtgggattcaacatcaagtgaattaacattaacactaatgcttggttttgcactgttctttgttgttattttactgagctacaccatttgggcttatgcgaagatgtttggtcgcttagatgctgacttcattgaagaaaacaaaaactcattatactagtaaggagataagattatgttttatgtgttatgggtagtgggtgttttgttcgctgttatgctaagtgcaatcattactatcggtcttgagaagactggtaaactcgacgaataaagagttttctttatcaactgaaaaataagggcttctaaagagccctttcatttcttctgttgtataaatttttcatgatcaaaagtaaaagtatttttaactaagcactgggtttattttaaggtgcgatgtatagtctaaaaaaatatttttcttttcactgtatttattcttgctaatatatttgactgaatctagaatacttggttcatttttcatatagaaatgagaaaataaaagactttgtgagggagagtaatatgcctgtttttaaattgcctgttcgtgtgtattacgaagatactgatgctggaggtgttgtttatcatgcccgttatctccatttttttgaacgggcgagaacagaatacttgcgaacattgaatttttctcagcaaaacttattaaatgagcgaaaagttgcttttgttgtgaagtcaatacagattgactactgtgttcctgcaaaattagatgacctattaattgtggaaacttatgttgtagctattaagggagcaagtatagttttttcacaaatattgaaacgagatgatgagatcatttcacaagctgtggtgaaagttgcgtcagtggatcttgtgaaaatgagacctgtggctatacctcaagaaataaaagcagaaattaaactaaatgataacattttcggagttatgtcatgaccgctgaattagattttttagaattatttttaaaggctagtattgttgtacaaatcgtaattgtgatattaatatctttttcgattatatcgtgggcgattattatccaacgtagtcgcattttaactcgagcattaaaggacagcacactttttgaagaacgtttttggtctggagaagatttgtataaattatatgatggactttctaatcatcgtaatggtctaaacagcagtgagcgaattttttatgttggatttaaggagtttaatcgtctgaaacaagctaatccggatgcccctgaagccattattcaaggcagttctagagcaatgaatttagcaatgaatcgtgaagtggaagatttggaaacacgagttccgtttttggcaactgttgcgtctattagtccatatatcggcttatttggtacagtatggggaattatgcatgcttttatggcattaagtggtgccaaacaagcaacattacagatggttgccccggggattgctgaggctttaattgcaacggctattggtttatttgctgctattccagctgtaatggcttacaatcgtttaagtctacgtgtgaataaattagagcaaaattatgctaacttcattgatgaatttacgacaattttacatcgtcaagcatttggtaaaaatcattaaatgtatcaaaattctccgtactgacggataaagtgcggttcttttttcataagtttagaggctatctatgtcttatcgtcgaaaacgtcgagatattaagtcagaaattaatattattccttttttggatgtcttattggttttattgctcatttttatggcaacagcaccgattattagtcagagtgttcaagttgaacttcccgaggctgtagaaagccaaaatgtatctaaagaagataaaacgcctgttattttggaggtttcaggtattggacagtatgcactttccattggtggggagcgaactgagggcataacagaagaattagtaactcaactttctaagcaagaatttgacaaagataataatacgttatttttggttggaggggctaaagatgttccgtatgaggaggtaatcaaagctttgaatttacttcatgttgcgggaataaaatctgttggattgatgactaatcctctttaaatataagtaggtaacacagtgtgtaatcatcgacaaaaaaatgagcttggtgccattctgctatcaatttttctgcatattttgttattaagtttgctggtattaggctctaactataataatgttgaaatcatgggaggtggagaaggtgatggtgaagtaatgtctgctgttatggttgatacgggaaccattgcaaaagagtggggacgtttacaggaaaagaaaaaaagcaatccggataaacaagaaacctttgttgaagcaacgcaagaagacgagttaatggagaatgttgatgtatttgaagaaaaaataagagaagatgaagaggtacagaaaagacttgcagagcaaaaaataaaagaagaaaaaattcagcaagagcgtttagcaaagcaattggaagaagataatgccaagaaagaggctgttgcaaagttgaaagcagaggctgaagaaatgcgtttacaggcattggcaaaaaaaattgaagaagagaaaaaggttagagacgctgaggaaaaacaaaaagcagagaagttagcgaaagagagagcagagaagttagcaaaagagaaagcggatagattggtcaaacaaaaggcacttaaggaagcaaaaataaaagcggaaaaagcagctaaagcaaaagcggaattagctcaacgcaaagcggaacaagcagcgttagatgattttttcaatggaggtgatattgcaggaagtagcaaaaatggtggaaatgcagcgatgaaaggttctcaaggagtgggtgctggttttgaaaacggcaaaggcggaagaactggagagcaatatgctgctcaaattaagagagaaattcagcgtcgctttctaaaagaacctaggtttgctaataaagtttgtgttattgaggttgaattagcaagagatggaacgatcactaactttagaaaattatctggctcagacgatatttgtactgcggggttatcagcggtatctagaacgaaaaaggtaccggaggcaccaactgatgagatttatagaaaatataagaaatttccactcgaatttagattgaaataattaaagaaactaaaaggtaaaatttatatgaaattttctgcatatttaactacattattcatagtgctttttagtttgttcatacaaaccgtacaagctgaaagtgaggtaagaattgtcattgatgaaggggttgatagtgctcggcctattgcgataattccatttaaatggaatggtagtgactctatgccgatagatgtagctgatatcatttctgcagatttacgcaatagtggtaaatttaatcctattgcagtcagtaaaatgcctcaaaaaccgacatcagcaagtgaggtaatttccgatgtttggtcttctttaggcattgatgcagtagttgttggacaagttacacccaatgaaaaaggatacagtatcgcatatcaattagtagacactatcggtgcttcaggaaatgcgggagaggtactaagtcaaaaccagtacgctgtaccgaaaaatgctattcgtttaggtgctcataccatcagtgatgaagtttttgaaaagctgactgcaattcgtggtgcatttagaactaaaattgcatacgttgtacaaaagaacggtggctcaaaaccttatcaagttcgtattgcagattatgatggacataatcaatttattgtttatagtagttcgcaaccattgatgtctcccgcttggtcgcctgatggtagtaaattggcttatgtatcttttgaaaatcgtaaatctcaattaattgtacatgatttacagtctggagctcgtcgggttattgctgcattccctgggcataatggagctccggcattttctcctgatggttcaaaaatagcatttgcttcatcaaaagatggtgtactaaatatttatgtcatgaatttaggaaacgggactatttctcagttgactagcggtgcaggcaacaatacggaaccttcttggtcaccggatgggcaatctataatttttacttcggacagagccggcggacctcaaatttatcagatggatgtagttggtaatggtgtatcattagtttctgctggtcgagggtatagtggaaaaatctctgcagatggtagtatattagtgatgatttatggcgataatattgttaaaaaagacctggcgacaggtgtgacggaaatgttaagctctactttcttagatgaaagcccaagtatttcacccaatggaattatgattatttatagttctacacaaggtctaggaaaggtgctacaattggtttccgctgacggtcgttttaaagcacgtctaccaagtagtgacggtcagattaaatttccagcttggtcaccatatttaaataaaaactaggagaggttaatgaaaaactttgcaaaattattagtagtagcgggttcagtggcagtattggcagcctgtagctcatctgataacgcatctaaaacaaatgctcaaatgtttggcggttattctgtaactgacttacaacaacgttataatacagtatattttgaatttgatagttatgatgtgcagggcgaatacgctcaaatcttagatgcacactctgcatacttaaagtcaacaccagcttctaaagttcttgttgaaggtcatgctgatgaacgtggtactccggagtataacatggcattaggtttacgtcgtgctgatgcagtaaaaaactttttattaaataagggtgttcaagctagtcaactttcaaccctttcttatggtgaagagaaaccggcagagttaggtcataatgaagctgcatattctaagaaccgtcgtgctgtattagcatactaatttcttaagccgggtatgatgcccggttttttattgcattttttcagtaaattttgaatttaagtaggtatatttgttttaaatgccccttttctgccgactattcgttcaaataaacaaaaaataaaaaaattttattgattattaaaataaaaacagtaatatatccgctcgttacaaacaatgagggtcgttagctcagtcggtagagcagcggacttttaatccgttggtcgaaggttcgaatccttcacgacccaccattttatttgtaatatcccaatttatgggtcgttagctcagtcggtagagcagcggacttttaatccgttggtcgaaggttcgaatccttcacgacccaccattttatttgtagtatcccaatttgtgggtcgttagctcagtcggtagagcagcggacttttaatccgttggtcgaaggttcgaatccttcacgacccaccagtcatatttaaagattcattcataaaaatattggttattcttatttatcgtgtcttttctgtttgtttctcttaagaggacatatacttaaaattagtcacttttctttttactaaattctatttttgcgatctgtatcgtaattttttttaattatttttacccatttttctagatgagttaaagtgcggtcaaaaataggaaaaaaaatgaaagcattaaaggggtttactctattagaaatattgattgttttactgattatcagtatgacagtaacattttcttttcccatgtggcaaacagcaaatacaaaaatgattttagaaaaagagcaaaataaactctatattttcataagggagctacaagctcgagttgaaaattctaatgatatttggtttttaattgctaatcgtgatttagtgagtaagcgttggtgcctggttgcacaaccaaaaaacacagatatatgtgattgtttaaatcctcgcagctgtaatagaaatattccgatgaaattttattatccttattttgcagataaaaccatgttaatcagcaaagtttattatcctagagaaatgactagattaaatggtacaaggaatacaagtacgacgacttgttttgtgttgcaatctgatcagcaaagaacagtattttcgttttttaatgtaggatctttaaaacttaaaggttaccaatcgttaagtgcttgcgtgaatgatcattagtaagggggaacattgattatttatcgtggacaaactttattaagtgtaatgatagcgttgagcttatcaatgatgttattaatgagtgttagtgcattttatagttatagtcagcaacaaaataaacagatacttttgcatctctatttacaatcagaattgcaacgaactatccaacttttgggtaaggatattcgccgtagtggatttagggctattagtgataaattggttcggagtaatttcgatttatttgaacaagataaaagcggaaagagtattgtagtcgctcaagctgataatgaaccttcgaatagttgcgttctttttatttatgatcttgatgctaccggctgtgtaggtacgacatatcgtaataatgtttgtgtaaggaataaacaaaatacagctcgtgaaattgagcgagagttatttggttatcgcttaaataaacaaatgatagagacaagattaacttataaaaattcaattagcgcgaattgtaatcaaaaacaatgccaaagctatttacaacaacctgcatgtaatagcggagggtgggtcgatttattagatgaaaatgacatagccataactgcattaaaatttcattggattgctgattacaatggattggaagtttatctaaaagggcatctaaagcgaaataaacaagtcgaatatgagacttcagccattattcctttgcttaatcaaaagagataaaaatgaatatacaaaaaggagttgtaacgctcaccctattaatgctgttaagctcagtattattaattttacttttttttgatggtgatttgatttcgttgcattcatccattgtttctcaacgaaaaatatatttagaacaaagtcttatattacagagacaaagtatttctcaaaaagaaaaactttgtgaaaaccagcctctgaataataatttgaaaagtttgaagatcgaatttgaaagtcgacgaaaaattgaccgcacttctcaatttatatggtgtgaaagaaaatatttgtttaaaaaaaggccgaaaaaagctatttatgaggcagggctaagtcagtatataaatcttgagttactggatttatttcaacataaattacattcaccgcctgctattttgccgagagataaagcaaattacctctattgggttgaggaaaaatcagctgaattggagatacaaggtaatattaatgcagttgttattgctgaaggggatttgaagttaacaggaaaaggtaaaattagtggaacggttattaccggcgggaaattaagtattgaaccagcagttaaaattgtgtatcgctcaaaaacaatcatcgatcttatccgatcatatagttattggcagtttgcggagaatagttggtatgattttcaaccattataaatttcctcaacggggtaccagcttgatcacgttattagtcacaatgatgatattttctacattatttttatttgttaatcaatgggttagttatcaaagaaaaagtgcggtaaatatttatctacgttatcaagctttgcaaatcgctgaaaatcaacatcaacgcttatttctagaaccgcattttcattgtccgcataatatcgagcaaaacggttataagtttaagatcaattgtgaaggtaagaatgtacgagtttcttatgcaaatcaacaagtaaatttattgcttgattaattattttgaaaagctatgctaaatgaagttattagaagaataaggaacatttgtgtttactttgtattattccaatcaattggaaacgcaaaaagatattttgttacatttaatgaatcaacagccattatcagatcctttccaaaaagaagttattttagtacaaagtggcggtatggcacagtggatacagtggcagattgcagagaaaaaaggtatatcggcaaatttgtcttttcctatgcctgcaagttttatttggcaattatatgttgataatttaccgcaagtcacagcttcttctcaatttagtaaagaaaatatgacttggcgattaatggaaattattccgcattatatagatcaaccggaattttacatattgcgtcaatatttacagcaaagttatcaatcaagtcagcagcgatactatcaattagccagcaaaatagcagagttatttgaccaatatttagtttatcgaccggaatggattataagttgggagcagaataaaggcgtagaaattattcagcaaattcagtattaccaaaaaaatttatttgtctcagaatcatgtttttctcaagttgagcaacatattgtttggcaaggtattttatggagagctttagtatgctctgtgcaaaaagaaacacaaaagaatgttttacatcgtgcacatctacatttacttttcttaaaacatattgccggcgaaaaacctaaaaatttgcctacgagaatttttgtatttggtatttcagctttaccgaaggtgcatttagatactttaagtgcattaagccagcattgcgatgtgcatttattttttaataatgcttgtcgtgaatattggggagatataattgatcagagccattggcaacgtttgaaagtgcgagagcgtataagttggcaagatttccaacaaccacaaaatacacaggcttggttatccgatgcgcaaatacatacttttgaacaaaatggatttgaacaaatttatgatgaaaagttacaggttggcaatcctttgctttcctcatggggaaaattaggacgggattatttgtatttactcactgaactggaggctaatgaaatcaatgcttatgtcgaactttcggaaaaaacattgttgtcgcaagtacaggcacgcattttagatttggttccttcgaagcacaagtttttaaatttggcagaaaatgaccgctctttaacttttcattcttgttatagtccaatacgagaggttcaagctctacaagattatttgttacatctatttaaccaagctcaggatttgacacctaaagatgtggtagttatggttgcagacattgataaatatgcaccgtatattcaggcggtattcagtcaaggcgaacactatattccgtactctatcgcagacagcaaactttccgaaaatgaccctttagtatctacttttttacagctgttaaatttaaaagaaagtttattcagtgcggaggaagtgctgacttttttggatcatcctgttattcgtcagagttttaatattactttagaggatttggcacaaattcgtcattgggttgagcattcgggtattcgattcggattagaaaaatatccgcaacaatccttgcaaaattataacgcttggcaggcaggtttagagagaatgttactgggatttgctatgcgggaagaaaatggtctatggttagatacgcttggctttgatgatacctatggattaaaagggcagcttgtcggttatttaaaggattttattactcgtttgtatcaatggcatcaatttttgcaagtagatcacgttattgaaaagtgggaagaacatttaattgaattaatgtcatctttttttgtggtagacggaatggatattccgcaacaatacaaaacaacttttaattatcttattgacactattcaacaattaacggagttgatcctagatagctcttttcagcaagaaataagtgcggaggttatttacgaagtttttgttgaacgcttaaaagatatacctaatagcctaaaatttttaatggggaaagtcactttttgtacgcttctccccatgcgatcaatcccttttaaagtggtgtgtttacttggtatgaatgatggtgattatccacgtcaacaaacgccgaacagctttgatttaatgcaatatcatcgcaaaaaaggcgatcgttttcgccgagatgatgatcgctatttatttttagaagcattgatctcggcacaacagtatttttatgtgagttatattggtcgctctattattgatgatagtgaacgagaaccttcagttcttgttacgcaattgttggattatatagctgaaaatattaacgctcaaggtgatctaagaggacaagatattctgaaaaaatcacttattcaacaacatgcgatgactgcatttagccgagaaaatttcaccaaaagagaccgctctttttctaagcaatggctagtgttggcaaataaaaaagatagtggcaatttggcgaattttttacagccgataaatgatacagagatagttaaagaaatttcattaaatgatttaattgcgtttattcaggatcctgttcggtatttttttgagcaaaaattacgtgtttttttacgtaagacagaacaaaatattgcggatactgaaaattttactttagataatttagagttatatcaaataaaagaagaacttatttatctttctgagcaggaatgggaagacttttttgctaggatgaaaattaagggaattatgccgcaaggggcgtttgcaaaaatttatcagcaaaaaacaaaaaatgagatcattacacttaaatctttagttacgccttatttggatcaaatatcggaacaaattcctgttgacttgagcgttgaaacagaatatggaaaagtgtgcttaacggggagcattgacagtttatatcatcaaaaaatgcgaagagtaacgtggagagcctctgctgtcaaaacgaaagatattatccaaacatggatttattatttattacaaaccttggttggagagcctaattcgcaagttgagcattacgctttagacagcagactttcttttgaaaaaatagaaaaatctaccgcacttcaacagcttcaaacttatgttgagtcatatttacttggacaagtttcagtgttattaatgccaatgaaaaatttcgatcaatatcttcaattgctttttactccgaagagtaataaatggaaagaggaaaaggatattgatttatctgcttgttttgaattgttatcagaacttggctcaggtagaaaagagagaaatttttatgtgaaaacagatccttattggcaaagaatattagcacaaacaaaactagaagattcacatattttagaaattaatcaacgtgttatacaatggttcgatttaatgttaatgctaaaaagagttgaatagaaaataaaaacaaaactggatatttatccagttttgttttatccttagtgctttattttacgctatgtaaggtgagatatgattgggcgtgtaacaggaatactggttgaaaaacaagctccggaaattttactggatgttcaaggtgttgggtatgagttacttttacccatgacaagtttttataatttgccggaagttgggcaggaaactacgttgtttacgcattttgtggtgcgtgaagatgctcatttgttatttggatttagccataaacaagaccgctctttatttcgtgaattgattaaaaccaatggagtcggaccaaaattagctttagctatcctgtctgctatgtcagtgaatgaatttgtgtatgcgattgaacaagaagaattatctaaattagtcaaaattcccggagtaggaaaaaaaactgctgaacgtttattggtggagctaaaaggtaaatttaaaggcttacaacaaacagatttctttattaaaagctctcatttacctggaattaaatgctcaaaaccggatcaaagtttgcagttggatgaagcagtttctgctttaattgcgttaggatataagcctattgaagcagagaaaatggttaaaaaagtgttaaaagcagatttaactagtgaacagcttattcgagaggctttgaaagccgcattataagagatagagaatgattgaagtagatcgcattgtaagtgccaatgcaaaagtagacgatgaatatattgatcgtgcaattcgccctaaattattgagtgattatatcggtcaagctcaagttagagagcaaatggaaattttcatccaagcagcaaaattacgccaagatgcacttgatcatttgttaatttttggccccccgggactaggaaaaacaacgttggcgaatattgttgccaatgaaatgggagtgaatattcgtactacttcaggtccggttttagaaaaagcgggggatttggcggcaatgctaacgaaccttgaacctcatgatgtattattcattgatgaaattcatcgcttatcaccagctattgaggaagttctttatccggcgatggaagattatcaactggatattatgattggagaaggtcctgctgctcgttcaataaagctggatttaccgccttttacgctgattggagcaacaacaagagcaggctctttgacttctccattacgagatcgattcggtattgtgcagcgactggagttttattctgtagaggatttagcttccattgttactcgaagtgcggtctgtttgcagcttgaaattgatgttgacgcaggacaagaaattgcttgtcgttcacgaggtaccccacgtattgcaaatcgcctattacgccgagtgcgagattatgccgatgtcaaaaatggtgggaaaattaccgcacttattgctcaagaagcactgaagatgctggatgtggatcttgcaggatttgattttatggatcgtaaattattacaggcaattattgagcggtttgatggcggacctgtaggattggataatttggcggcggcaattggcgaagagcgagatactattgaagatgtacttgagccttatttaattcagcaaggatttttacaacggacacctcgtggaagaatagcaacatcaagaacttatcgacattttggtttggaacagattgaaaaatagcactcttttttcagtcgctctcaacgtgagtcagtcgatagtcaacgatttcaagtaacttgtgggtttgtgcgagtatccttctattctgtagtaaagattctgcaaaggtactatttattgctcaaaattccatttgcacacacataggctgagctccatgcccattggaagttataaccgccaagccgaccggtaacatcaagtacttcaccaataaaataaagacctttgattttatgactttccatcgtttttgatgagatttcttgcgtatctacgcctccaatagtgacttctgcggtgcgataaccttcggtgccgttaggttgaatttgccaatgatgaattaaatcatcaagattttttaactgcactttactgaggttggcaatcacttcatcttgaataatgttgtgatttaaccataaatccactagtttttgcggtaataggcgtgataaggcggtttttaaatgtaatttaggtgaggtctgacgtaacttgttaaggaaaaattgaatattttccatcggtaacagatcaatttctatattttcattcacttgccaataatttgaaatttgtaaaatagcgggacctgatatcccccgatgagtgaagagtaaattattgctgaaagattgaccgcactttgcggttacacaaacaggaagggagatgcctgaaagtgcggtgtaaaatttatcaatttcacgccatgtgaagggtacaagcccagctcgtggagcaataacattgagtccgaattgttcggcaacttggtaaccgaaaggtgtcgaactcaaggctggcatagacaatccgccggtagcaataactaaattttcacattgccaaatttttccgtcagattgcaattgaaaacgagctttttcattaccgtctaatttttcaatgtattcgatctgttgacgtaattgggtattaacttgaaatttatcgcattctgctcgtagcatattgacaatatcttcagcactgttatgacaaaaaagttgccccgattctttttcataatagctaataccatagtcagtaatgagggcaataaaatcccattgggtaaagcgagctagagcagacttgacgaaatgaggattttgcgaaaggtaatgctgaggggtaacattaaggttggtaaaattacaaaatccgccaccggacattaaaattttacgtcccactttttttccattatctaaaatcgttacttggtgcttggctttacctagttgaccagcacaaaacaagcctgccgcacctgcaccgataataattgtttgggaataattcatcattatttattcgctaaaattaccgctcttttgggagccgggtacccttcaatggttttactgtgatcttgaggattaaggaaatcaattaaactttcattttccagccagtctgttttacgttgttcttctagacctgttgtttctacatcgacacaacgaatattatggaaaccgcacttttccagccagtttatgagtgcgagaacggaagggataaaatacacatttttcattttggcatagcgatctgtcggcactaaaatcgtgtttatatcaccctctacaactaacgtttcaagtactaattcgccatctttaactaattgatttttaagttgtgtgagatgatccaatggagattttcgatgatataaaacgcccatagaaaagacggtatcaaaggcggctaaaggttgcatttcttcaatgccgagcggaataagattagcacgacgatcattgtttaacagtttacgtacagcctcaaactgacataaaaacagttctgtcggatcaataccgactaccattttggctccttcgccaaccatacgccacatatgataaccgctaccacaccctacatctaacacaagacgattctgcaaaggtgccaaatgaggcaagacacgctcccatttaaaatccgaacgccattcacaatcaatatggataccatatagatgataaggtcccttacgccaaggcataagctgttttaagtgatgaatgatgcgttgtcgctcaccggaggaaagaggcgtttttgtttcagctttgaccgcacttttgagatcaatatgatcggctgttaagtgcggtagaaaatcaatgatttttgaccatttaatataatcgccatgggtttgcttttcccattgtttaagttgtaaaggcaaagtttcaagccatgctgaaagtgtcgaagttgctatttgttgatagaatggacgaaagtcgaacataattattttgatgccttatatgcgtttttagcttgttcaaacgtctctaaaatcgatttttccggtttcactgataacaaagaaacaacaataatgacaatgcttgccaaagcaaaacctgggatcatttcatataatttagagaattcacttgttgtagggacaatggttttccaactaaatacgataattgtcccagttaacattcccgccattgcagcagaagatgtcatgcgtttccagaataaagaaaatagtacaacaggcccaaaagcactaccaaatccagcccaagcaaattcaactaattttaaaacttggcttttttcatcttgtgcaatccaaattgcaatggcggcaatagctaataccattaaacgaccaagccacatcaattctttatccgatgcttttggacgaataaatcctttgtaaaaatcttctgtaacggcactggaagaaatgagaagttgtgcactcagcgtactcattactgcggctaaaatagcagaaagtaagataccggcgatccaaggattgaacaataattttgataattcaataaagatttgctccgattctttgttgacgacaccagctagttgtggatttgctgcaaaataggcgatgccaaaaaaaccgatacctatggcaccgactaaacaaaggatcatccaagtgatactaatacgtcgtgcgttattgagcgattttactgtgtgtgccgccataaagcgtgccagaatgtgcggttgtccgaaataacccaatccccaagaagccaagctcagtagaccaattgtggtagtaccggtaaaaatatctgtaaagttttttcctaccgcactttcagcctgcttcaagtagaaatgaaaattatctattccgtctaagcttagaataatcatgataggggttagaatgagtgcgaaaatcatcaatgttgcttgaatagtatctgtccaactcactgctaagaaaccgcctatgaaggtataagcaatagttgccaatgcaccataccaaagtgcggtggaataagggatactgaacagattttggaataattttgcaccggcaacgacaccggaagcacaataaattgtgaagaaaacaaggataattgaggctgacacaattttgagtaaattatgacgactaccaaaacggttgtgaaaatattcaggtaatgtgagagcgttattattaaattcagtgtaaatacgtaagcgacctgccacaaataaccagttaaaataagcaccgattgttaaacctatggcaatccaaccttcaattaagcccgacaaatagattgtacccggtaaacccatcagcaaccaggcggacatatctgatgcaccggcagacattgcggtaacaaaactgcctaaacgacgaccgccaagaatgtagtctgaaagattattggtgtagtaatatgcaagtgcaccaatcaataacatgcctaagatatagacaataaaggtaataattgttggatcaaaactaaacattaagccctcacgaaagcattatttgtatagataaaatttaagaaaggtcgcattttaccttattcagggctattattctatttaccttttcgatagactaattaaaagaagtatttttaggatagagatgatggaatctgttgaattattggctaacattacccctagtgaaacccgaattgcactggtggataatggcattttaaaagaagtacatattgaaagacaggcaaaaagagggagcgtcggtaatatttataaaggacgagtgactcgagtattgccgggtatgcaatctgcatttgtagatatcggattggaaaaagccgcttttttacatgcctcagatattgtttcacatacagagtgtgttgatgttgatgagcaaaaacagtttgtagtgaaagatattgcacaattggtacatgaaggacaggatattgttgttcaggtggtaaaagatcccctcggtactaaaggtgcaagattaacaactgacataacactcccttctcgttatcttgtttttatgccggaaaatagccatgttggcgtttctcaacgcattgaaagcgaagaagagcgggcacgtttaaaggaacttgttttaccgttgtgcgatgaattgggcggttttattattcgtactgctgccgaaggagcaacggaaactgaactcgtgcaagatgcggaatttttaaaacgattatggcgtaaggtgttggaacgccgtgcgaaatatacaacacgttcaatgttatatggcgaattggcgttaacgcaacgtattttgcgagattttatcggggcgaatttcagtaaaattcatattgattccaaattatgtttttctgaagtgaaacagtttactgaggaatttatgcctgaactgacagataagttggtgttatattccggcagtcagccattatttgatgtttatagcgttgaaaatgctattcaaacagctttaaatagtcgtgtaaacttaaaatccggtggctatctaattattgaacaaaccgaatctatgacaacgatagacattaatactggtgcttttgtgggtcatcgcaatttagaagaaactatttttaatacaaatattgaggcaacaaaagctattgcacaacagttacaactacgcaatctgggcggtattattattattgattttattgatatgcaaacggaagaacatagagatcgtgtcttggaatctttacgtttggctctatccaaagatagagtgaaaacgaatgttaatggttttactcaacttggtttagttgaaatgacacgtaagcgaacaagagaaagtttggagcatattttatgcgatgaatgtccaacttgcagtgggcgaggcagtgtcaaaactgttgaaacagtttgttatgaaattgtgcgtgaaattattcgagtcaatcatttattttccagtgagaaatttgtagtttatgcctcaagagcggtggcggattatttaattaatgaggaaagtcatggcttgttggcagaattggaagtatttatcggcaaacaaattcaaataaaaacagaagtgtattattcacaggaacaatttgatgttgttgtaatgtaacttccatttttaatatgttatattgacctcatattcattattcaaggtgtcggtatggttaagaatattggaattttatatattgcgacagggcgttatcatgttctttgggaagatttctataaaagtgcggaaaagcattttctacctgaattacctaagaaatattttttattttcagattatgagggaagttttttaggtgaggaaagtggaaatgtttacagaatatatcaaaaaaaattaggttggccttatgatacgttgatgcgttttgatatgtttttaaaagagaaagagcgatttaaagagttggattatctcttttttattaatgcaaatatgatttttattaaagatatacatcaaaatgaaattcttgcatccgataaagagttaattatggcgttacaaccttggtttatcggattagatattgataaaacgacttatgatagaaatccgttgtccacggcatatattccttatggggagggtgagcattatgttatgggaagttttaacggcggtaaaactcctgcttttttagagatgtgtcagcaattaaatgacaatacctatttagatttaaaaaaagatattattgcactatggcatgatgaaagtcatttaaatcattattgttggcgaaataaagagaaaatatttattttgcctgacagttatttattggatgaagggcaaaagtacttcccaagtaaaaagtctcattatattaatcccttatatttaagaaataatgatgttcgattagttatgagaaataagaatcattataggttcggggggggggaattacatgagagggattactgatgaacgaattgaatttagttgggcaactttctcattgaacttaaggggatatcgtcgctatttaaaagagagaattagggcgatatttaaagttctttataagaactaatattgttaatgtaggacaaaaaaccaagatgttaaacaaagtacaagaatctatacttgctccaaataatttagaaccggataatttaaaaaatatatttgatgtgttgtcccatcgtcagattgattatgcagatttgtattttcagcttagtcaagatgaaaattgggtgttggaagacggtattatcaaagaaggcggttttcatattgaccgtggcgttggtgtgcgtgcggtaactggcgagaaaacaggatttgcttattccgatcagattgatttggtcagtttacagcaatgtgccaatgcagtaaaaggaattgctttgccaaatcaaggtaatattattaaaccgattggttttaaagctgtaaatgcggttactcgttatcctgcagtaaatccgttaaatagtttgaataaagagcaaaaaattgaattattacatttagtagaccgtaccgctcgtgcatatagcccttatgtgacaaaagttgtagcgaatttaaccgctctttatgaagaaattttagttgtggcaacagatggtacgttagcagctgatgttcgaccgttaattcgtttatctatttttgtgatggcggaaaaagcgggaaaaagagaacaaggaagtgcgggcgttggggagagagtaggacttgattggttctttgagccttataagggcgaacaacgtgcgatttattttgcgaaagaagcagcacgtcaagcattggtgaatttagacgctattgaagcacctgccggcttgatgccggtagtgttgggtgctggttggccgggtgtattattacacgaagctgtggggcatggattagagggtgattttaaccgtaaaggaagctcattgtttacaggaaaaattggggaattagtcacttctccattatgcactattgttgatgacggcactctaccgaatcgcagaggctcgttgacaatagatgatgagggcgtgccaagtcaatgtaatgtattgattaaagacggtgtcttgcagggttatatgcaagataaaatgaacgctcgcttaatgggtgtgaaaccgactggaaatgggcgtcgtgaatcttatgctcatttgcctatgccaagaatgactaatacttatatgttagcggggcaaagtaagtttgaagatttaattgcttcggtcgattatggcatttttgcaccgcactttggtggtgggcaagtggatatcgtctccggaaaatttactttttccatgtcggaagcctatttaattgaaaaaggcagaataaccaagcctattaaaggtgcaactatgatcggacaaggaattgaagtgatgcaacaagtatctatggtagccgataatatggaaatagaccatggcataggtgtttgtggtaaagatggacaaagtgttccggttggcgttggtcaaccggcttgtaagatagagcaaattaccgtgggcggaaccgcttaattaaactatggtgaatttgtgatttgttagataattaatttttatagagaatatagacagtgactgaaacgactcaatcaaatttgcaattggctcaagcatataacgaactaccttatacttctaaagtttttgctgcttgtcaacctactcgtttacatgctttagctaagattaaagggcttttaccccccccccttagaaacagctaaggtgctggaaatcggttgttcttttggcggcaatttattgccctttgctattcgacaccctaatagccagttagtcggtattgatttatctgaataccaaattaatatcggtcagcaaatgatggaacaggtcggcgtgaaaaacgtagagttggttgctgctgacattagccaagtgagctttaatattaagtttgactatattatttgtcatggtgtttttagctgggtgccggaagcggtacgccatgcaattttaaaaaccatccaagagtatttatctcccaacggtattgctcatattagttataatacctacccagggtggaaaattcgagatgtcgctaaagagctgatgtgttttggaagcaatccgaatttaagcagtttggagcgtatagaccaatcttttgagttattaaaatttacctcttccattttgcaacgaaagaatgctgacttatataaagtattatcgcattcatttcaagaaatacctgataaagataaattttacgtggctcatgaatactttgaggattttaaccaacctttctatttcagggaatttatcagccaacttgaggcataccatttagcctatttaaccgatagttcttttcccgctatttattcagatgtgcattttgaacatgatgaatatgagaaagtgtgtgcctattttgattaccgcttggaagccgtagagcaatttattgatttcctgaataaccgctcttttagacacagcattattacccatcaacaaaatttggcggacaaagggattaccaataatatcagtcaatacaatcattgccatcatttctatgatatctatttcagaacagatgtgcgttatagccctgcgactgatgataaggaagcgcattggcagttgctggacataggtgccgaaatttcggataccccattaaataatttattatgtacttatcttcaagagcataacaatccttgtaaaattggcgatatttgtgagtatgccaaaaaattccccgaatatgacgaaactgaactttacaaattgattctttctattatttattctaatcatgtttatttatgttttgagccagagacatcgaccggctatgacagcaaacccaaattgtttgagccgtaccgaagattgattgatttggtcagacataatcccaatgttaccggcttgtccaatcgatactatcaggtactcaacttagatttcttgccgcaatatatcgcacaatttctcgatggcactagaacagtcaaggatttaatcaaacaattgcgagaggacattgaaaacaataccattgtccttcatgatgaaaacggcaatgaactttcgaataaaaagattaaagataaagacatcaaagaagtgattgttcggcaattggacgcacttaaggagtacggttatttcacggaatataaatagtactgtgtaaattgtccaatcgtgagatagtgtagggagcgtatttaatattgcattgaatacgctctatttgtttaaatttaaactttaaaatcaggtgctaaacaaggttggattttattgagtatttcttttacaagacgtggtgttgctgcaacgatatgactgtcagtgaaatatttatgaccaccgtagaaatcacatactaaaccaccagcttcacgtaaaatcagatcacctgccgtaatatcccaaggtttaacgcccatttcaaaataaccgtcaacacgattagccgcaacatagcaaagatcaagtgcggcagaacctgcacgacgaaaatcagcaacattttcagcaaggttactcatcatagcaaattgggttggcatgagagagggttttttgaatggaaatccggttgccaaaattgcaccttgaaggtcacgtttactgctatcaacacgtaaacgtaattcattaattttcgcaccttcaccacgcacagcggtgaataattcattgcgaataggatcataaaccacgcctatttcagtgcgaccttttacacggacagcgatagatacagcaaagtgcggtaagcctttgacaaagtttgccgtaccatctagtggatctattacccattgaatatcgttgttttgtccttcgtgagcaccgctttcctcagtaataattgtatgctcgggataagatttgcgaacaacttcgataattgctacttctgaggctttatcaatattcgtaacaaaatcatttctacccttttgcattgtttgaatttcatcgcggcgttcataacctttaacaattatattacccgcttttcgtgccgcacgaatagcgatatttaacattggattcatctctttccaccagatttcaaagaacacatggggtgggattatagtgaattttgcctataaaagcgagtagattttaggtttcctaacggttttttagggatcaaataacttttcgtaaattataggggctatgctaaaatacccacaattttaagtaaggtaaaagtcttaatgttggaaaatatcaaaattgttttagttgaaacttctcacagtggcaacattggttctgctgctcgtgcaatgaaaacaatgggactaaatcaattatgtttagttgcacccaaacagggaattgatgaacaggctgttgcgttagctgccggtgctgaagatgtggtaaaaagtgcggtagtggcggacagtttttctcaagctgtagcggactgttctcttattattggcacaagtgcaaggttaagacatttacaaagtaccttaattgaaccgagagaatgtgctgaaaaggtcatacaaagtttgtcatctcaaaaagtagccattgtttttgggcgtgaacgagttggactgacaaatgatgaattattaaaatgccattatcatttaactattccggctaatcctgaatattcttcattaaatctggctatggcagtgcaattaaccagctatgaacttagactagcttggcttgcctcgttaaaagaactgaaacaaccgttttctgtgatagcaaataactatccgacatttcaagaattagagcatttttttgcacataccgaacaactctatcaacaacttggttttattcaaaatcaaggggttatgaaaaaattaagacgtttatatcagcgtgttcaacttgaaaaaaatgagttgaatattttgcgtggtatgttaagtgcggtagaaaagcgaattaattgcaaaaaattagaagttgactaatttagtaggattagtaatatatccgctcaatgtggatctaaaggatattgagaatgaaattaacatcaaaagggcggtatgcggtaacagctattttggatattgcgttaaatgctgagcttggacctgttagtttagcggatatctctgaacgacagcatatttccctttcttatttagaacagctttttgctaaattacgccgtggtggtttagtgaaaagtgtgcgtggtcctggtggcgggtatcagttaggattatctactgagcagatctccattggcatggtaattaatgcagttaatgaaaatattaacgttacaaaatgtttggggaatggcgattgtcaggggggagtaaaatgcttaactcattctttgtgggaagaattgagtgtacgaattgaaaatttcttaaatgaaataacgattgcagaattagttgcaaaacaagccaagtgaaatgagcagtacacgtttgagatagtgataaaaccggctaaaagtgcggtacaagaaaagattttttaggagagagtaatgaaattacctatttatttagattatgcggcaacttgccctgtggatgaacgtgtagtgaagaaaatgatggagtttttaagcattgatggaaattttggaaacccggcatctcgctcacataaatttggttggcaggctgaagaagcggttgatgttgctcgcaatcatattgctgatttaatcggtgcggacagtcgtgagattgtttttacttctggtgcaacagaagcggacaaccttgcattgaaaggagtgatgcgtttctatcaaactaaagggaaacatcttattacctgtaaaactgaacataaagcgatcttagacacttgtcgccagcttgaacgtgaagggtttgaagtgacttatttagatcccaaatcagatggtttgatagatttagaggaattaaaatccgttattcgtgatgacacggttttggtttctataatgcacgccaataatgagattggtgtagtacaggatattgctaaaattggtgaaatttgccgtgaacgtaaggtattatttcacaccgatgcaactcaatccgtcggtaaattgcccattaatttgagtgaattaaaagtagatttactttctatgtccagtcataaattatatggacctaaaggtataggtgctttatatgtttgccgtaaaccacgagttcgtttggaggcaattattcatggtggcggtcatgagcgtggtatgcgttcaggaaccttacctgtacatcagattgtgggtatgggtgaagcatatcgtattgctaaagaagaaatggcaacagaaatgccacgcttaaccgctttgcgtgatcgtttatataacggcttaaaagatattgaagaaacctatgtaaacggttcaatggaacaacgtttaggtaataatttaaatattagttttaattacgttgaaggtgaaagtttaatgatggcgttacgagatattgcggtatcttccggttctgcctgtacatcggcaagtctcgagccttcttatgttttgcgtgccttagggttaaatgacgaattggcacatagctcaattcgttttactgtggggcgttatactacggaagaagaaattgattattctatcggtttagttaaaagtgcggtgaaaaagttacgtgatttatctccactttgggatatgttcaaagagggtattgatttaaacagtattgaatggactcaccattaatagaagagtttagcagtttgttgggtaggtttatcgcttacccattttaagaaatgagaaaaaataggaacgaaaaatggcatatagcgaaaaattacttgatcattatgaaaatcctcgtaatgtaggttcttttgataaaaaagatccgacagtcggtagcggtatggttggtgcacctgcttgtggtgatgtcatgcaattacaaattaaagtaaatgatgaaggtatcattgaagatgctaaatttaaaacgtatggttgtggttcggcaattgcgtcaagttccttaatcactgaatgggtgaaaggtaaatctttagatgaagcccaagcgattaagaatagccaaattgctgaagagttggaattgccgccggttaaagtgcattgctcaattcttgcagaagatgcgattaaagctgcaattgctgattacaaagcgaaaaaagctgaatagttaaagaagattaaaggagtaatgaggtgcatataattttaatattaagccacattattccttttgtgtttagttccctttagttggatttatgtttagataggtagttaaatttctagcagttataatgagttgagaattaactatattgattaaggagaataaatgagtatcaccttaacacaagcagcagcaaaccgagttcgtacttttttagaaaaaagaggaaaaggaataggtttacgtttagggattaaaacgtcaggttgctcaggcttagcttatgttttagagttcgttgatgttttaaatgaagatgatgaggttttcgagcaagatggcgttaaggtgattgtggatcataagagcttagtctatttagacgggactcaactggattttgtcaaagagggactaaatgaaggctttaaatttagtaatccgaatgtaaaagatgaatgtggttgtggtgaaagtttcaacgtataggcaggcatatatatgataaatccatttgcgttatttgatttggaaattgattttaatcttgatcaacaaatactctcacagcgttatttaacgctacaaaaatctttgcatcctgataattttgctcatagatctgcccaagaacaacgtttagcactgcaaaaatctgctgaaattaatgatgctttacaaatactgaaagatcctatcagtcgtgctgatagtataatcaatttgtatcttggtgaacaaaatatagagcaaaaaactaatcaagatatgatgtttttgatgcagcaaatggaatggcgagaacggttggagcaagttgagcaacaacaaaatatggataagttattacacttctcgcaagaggtcgagtgtgtacaacgtgatattttagcggagctacaagaatttctagcacaacaaaattggcaacaagctcaattgctaaatgatcgtttacgttttattaaaaaattatttgttgaaattgaacgggttgaagaacagttagctggtttttagctcagtaatttatttagaaagttatgacgagataatagagtatggcattacttcaaattgcggagccagggcaaagtgcggcaccgcaccaacataaattagctgtaggtattgatttggggacaacaaactctttggttgcagctgtacgtagtggaagtagtgaagttttgcgggacgaacaggatcgcttgcttattccatcgatagttcatttaacagaagatcaagtgattgtggggtatgaggcaggtaaacttgccagtcaagatccgcaaaataccattatttccgtgaagcgtttaattggacgtagttgtactgatgtacagcaacgttatcctaatttgccttatcaatttagtgcaactgaaaatggcttacctctattaaagacaagaaggggattattaagtccggtagaaatttcagccgaaattttgaaaaaattgaccgcacttgctgagcaacgtttgggtggagaattaactggtgcagtgattactgttcctgcttattttgatgatgctcaacgacaaagtaccaaagatgctgcaaagttagcaggtttaaaggtattgcgtttacttaatgagccaaccgcagctgccatcgcttatggtttggatagtggacaagaaggtgtgattgctgtttatgatttaggcggcggtacttttgatgtgtccattttacgcttatccaaaggtgtgtttgaagtgcttgctaccggaggtgataccgcacttggtggtgatgattttgatcatttattagcggagtggattgtaaaaaaatcaacagtcgcacctcaaaatgatcgtgaaaaacgtcaacttattgagcttgcaaaccaaattaaagttgctttgaccacgaacgataaaatccggatttcttatgcagagcaaaatctggaaattatgcgtgatgaatttaattctctgatttcaggtttagtcaaacgttcattattagcttgtcgtcggacgttaaaggatgccaatttaactccatcagatatattggaagtagtgatggtgggcggttcaacgcgtattccttatgttagagaacaagttggtgagtttttccaatgtacaccgctgacttctattgaccctgataaagtggtggcattaggtgcagctattcaggcggatattttagtaggaaataagcctgatagtgaaatgttattactcgatgtgattccgttgtcattaggtattgaaactatgggaggcttggttgagaagattattcctcgtaatactactattccggtagcaagagcacaggaatttactacattcaaagatgggcaaacagctatgtcggtgcatgtgttacaaggtgaacgtgaaatggttactgattgtcgctctttggctcgttttactttacgaggtattccggctatggtggcaggtgcagcacgtattcgagtcacttatcaagttgatgctgatgggttattaagtgttactgcggtggaaaaatcaacaggagtacaagcatcaactcaagtaaaaccttcctatggcttaactgatgatgaaattgctaatatgctaaaatcctcaatggagcatgctaaagaagatattcaaactcgtttactaacagaacagcgtgttgatgctaccagagtcattgaaagtgtttattcggcattacagcaagatgaagatcttttagatgataatgaattaagtgcggttaaaaatgccttagtttcattacaaaaattgattcaagaagaagatagccttgctattaagcaagggataaaaatgcttgatcaagcaacgcaagaatttgcctctcgccgtatggataaatctattcgtcgagcattaagcgggcaacatattgaacatattaaataaaggaaagtagaatgcccaaaattgtttttttacctcatcaagatttttgtcccgaaggaatggttgttgatgctgcaccgggagaaaatctattagacgttgcacataatgcaggcgtggaaattcatcatgcctgtgatggctcttgtgcttgtaccacttgccatgttgttattcgagagggatttgacagtttaaatgagacaacagaacaagaagaagatatgttagataaggcttggggcttagaaatggatagccgtctttcttgtcaatgtgtggtcggagaggaagatcttgtagtagaaattccacgttataatttgaatcatgctaatgaagcggctcattgatccatttatatcaaggtgcatttagcaccttaattattatgctcaaattatataagttatatccaattattctttgctttttgagcgaaaattcagtaatatacaggctttattctcaagtaaaggggatataaatgaaaatccaacatttaattaagcaacatcaacttggcttattgtttcaacaaggctcctttggtttagaaaaagaaagccaacgagtttatcaagacggttcggtagtaacaaccgaacaccctaaatgttttggtaacagatcttaccatccctacattcaaactgattttgcggaaagtcagctcgaattgatcacgcctcccaataaaaatttagaagatagtttaagatggttatccgctattcatgaagttgttttgcgttctttgcctgaggatgaatttatttttccgttgagtatgccggcaggattgccttcagatgaattgataaaagtcgctcaattggataaccatgaagatgtggcatatcgtgaacatttagttcagtcttatggcaaaaataaacaaatggtcagtggaatccattataactttcagttggatccagcacttattcaaaccttatttaatttacaacaagaacaaaaaagtgcggtagattttcagaataatttatacttgaaaatggcgaaaaattttcttcgttatcaatgggttctattgtacttattatcagcgacaccaacagtagagagtaattattttaaaggtagttcgccattaggaaaaggtgaatatgttcgcagtttacgttcaagcaaatatggttatgtgaatgatcctgaggtcattgtttcctttgatagtttagaacaatatgcagaaagtctggagcattgggttaaaagcggaaaactgatagcagagaaagaattttattccaatgtgcgtttacgaggtgcgaaaaaggcgagagatttaattcaaaatgggattaaatatttagaatttcgcttgtttgatctcaatcctttcgagcaatacggtattagccttgcggatgcaagatttattcatcattttgtactattgatgatttggcttgatgaaatgccagatcaacaaggtgttgaattggggcgtagccgtctagcggaagtagctctagaaaatccgttggcacaaactgcctatcgagaagaaggtgagtggttacttaatcagttaatcagtatgttgcaaagtatcggagcagaccaaagtgcggtgagttttgtccgagaaaaattagctcaatttgctgatcccgggttgacgttatgtggtcgtttagtccaagaaattgagcagaaaggcggttatcaaaaattaggtgcagagcttgccaaacaatataaagaaaatgcttttgagcgtttttatgcgttaaccgcttttgataacatggaactttcaactcaagccttaatgtttgatttaattcagcaaggtatcagttttgagatcttggatgaacgagatcaatttttacgcttacaatttggtgaacatgttgaatatgtaaaaaatggtaatatgacttcgaaagatagctatatttctcctcttattatggaaaataaagtggttacgaaaaaagtattggaaaaggcggggtttaatgttccacagagtcaggagtttacttcagttaaacaagcgatagtcggttatagcctgtttgaaaaaagagcggtcgttattaaacctaaatctactaactatggcttggggattacaatttttcagcaaggtgtgaataatagagaagattttgccaaggcagtggaaattgcgttccgtgaagataaagaaattatggtggaggattatttagttggtactgaataccgcttctttgtgttgggtgaggaaacgctggcagttttattacgtgttccggcaaatatagtaggcgatggcattcatactgtggctgaattggtagctcaaaaaaatacgcatccattgcgtggtgatggtagtcgtacgccattgaaaaaaattgcattaggcgatattgagcaattgcagttgaaagagcaaggtttgactgttgagagtattccagctaaagatcaaattgttcagttgcgggcaaattctaatattagtacaggcggtgacagcattgatataactgatgaaatgcatttgagttataaacaactggcggtggggattgcaaaagctatgggggctgctgtgtgcggtgtggatctgattatttccgatttgaaagaaccggcacagcctgatttaagttcttggggcgtaattgaagcgaattttaatccaatgatgatgatgcacatcttcccttatgccggacaatctagaagattaacaagaaatgtgattaacatgttgtttccggaagtaaagtaaataatgtttttcgtaaaataggcggtttttagactgttaatgataagggctggtagtttaccgagaaatttgatttgctggtgtaatggaaaaaatggttgctaataatatatttttgacgttattagcaacgattttgtctattatgctactgcttatggtaagcaattatagtgagtcccccaacaaaacagattctaatgcaatttcgatcatttcattgaaagttaattgtcgctcttctgcactggtttgttcatgcgtacggatatgatcagaaacagtacagattgttaaggctttggctttaaattcagctgctacaccataaatgccggcagcctccatttccacacctaaaatgccatatttttccatgacatcaaacatttctgggtctggtgtataaaataagtcggcggaaaacaagttacctacttttacatcaattcctttattttttgcagcctgtacggctgcttgtgccatgccaaaatccgcaatggcagcgaaatcgttatctttgaaacgaatacgatttacctttgagtcggtacaagcaccaagaccaataatgacatcacgaattttaacgtccattttgaccgcaccacaagaaccgacacgaataattttttttacaccatattctgtgatcaattctttagcataaatggagcaagatggaattcccattccatgtcccatcactgatatttttcgtcctttgtaagtacctgtgtaaccaagcatattacggacatttgttacttcttgtgcattttctaaaaatgtttctgcgatatattttgcacgcaacggatctcccggcattaaaacaacatcggcaaatgcaccggctggtgcgttaatatgtggcgtcataaatgtgtccttttgttgattaaaatattatttttccttaaagcaataaagcaatcgttttcttttacctaaagtgaacacaccacgaaaggtcatggtgtgaaatatggatgacggaattgaaccgcacttttacagtgctgcaccacttaatccaataaataaaccggcaatagttgcactcattaagtttgctaatgagcctgcaattaccgcttttatacctaaacgagcaatatcaccacgacgatttggtgccattgcccctaagccaccgattaaaattgcaatagagctaaagtttgcaaatccacagagggcaaaagtaataattgctttagttttatcacttaattgcaccgttgcatcagctgcaaggtatggtacaaaatctaaataaccaacaaattcattaattgctaatttggttccaatcatacgaccggcaatttccgcttcttcccaaggaaccccaataatgaaggctaacggcttgaaaacccaaccaaagatcatgccaagagaaagtccttcttgaccaatccagtttccgatagtgccaagaattccgttaagtaatgcaattaaagccacaaatgcgatcaacatcgcacccacatttaaggcaagttgcataccagatgatgcacctccggcggctgcatcaagaatatttgttggtttttcttgttgtatttgttcgaaattatcattaaatttttcagtttgtgggataagaattttagcaaataacaatccggctggagcagccataaatgaagctgcgattagataggttagaggtacacccattccggcatatccagccatgactgaaccagcgatagaggctaaaccaccgcacattactgcaaacagctctgattctgtcattttgctaatataaggtttaatgactaagggggcttctgtttgtcccacgaagatattggctgctgccgacatagactcggattttgatgtgcctaatgctttttgtaatgctccgccgatgattttaatcagccattgcattacaccgatatagtaaagtagggagattaatgcggagaagaaaacaatatttggaaggacgttgataacgaaaacaaaaccagctgatcccatagaaccatcggcttgtggcgctaacccattaaatagaaaacggatcccttcattaccataattgatgactgattgtactgctcctgcaacgctttgtagtgcctgacgaccaacgggaacataaagaataaatgcaccaaataaaaattgaattaatagtgcacctagcactgtacgataattaatcgccttacgattattagataaaagaaaggctattaataataaagcgaagataccgataatgctaatcagagaactcataatgtgaatatccttataggtgtgttaaaaatgcacgtattctactcggttttatataaaaaatcttgtactttctaagtgagttatagcttttttaaatttataaatattctttgttttggattaaatttaatttcgattatgattaacacaacgcaactgttgggtcgtaataatgaaaaaatttaatgagcttcctcaaactccttgggcagccaaatctttgtgggaaatagaaacaaaatcgctattggtattatgtttttcactttccttgctcggtattggtgatggattgttggttttatctaatttaggctctgcaccttggacagttttgtctcaaggcattgctttacaagcacaatttagtgttggctgggcatcatttatagtaagtatcttagtaatgttaatgtggattccgttaaggttaaaagttggttttggaacaattctgaatgttgttctgatcgcattatttcttggtttaagtacattttatatttctccgccgagttcccttttagcaaggttttgctatcttataatgggtattattttttttggcatcggaaccgcattttatttgacttgccatcaaggggcaggacctcgagatggattaatggttggattatgtcatcgctttaaattaagaataggaatagtccgtactcttatggaggtttctgtttgttttttgggttttttgctaggcggaacagtaggaattggtacactattatttgctaccagtattggttggattattcaattaggggtttattttattatgaaacttaacaagtcggtctaagaaatatggcattattgccagtcttaattttaaagcatataatctttgccattttattctatatctaaataaacctatgatgagattaccaatcagtgtcacaatgcttgtgaaaaatgccgagaaatatttggcaaaaagccttagttctttgaaagatttccctgaaattattgtgttagataatggatcaacagatcgatctattgaaattgcaaaacaatttactaatgtcaaaatttatcattcacctttcattggttttggaccgatgaaaaatttagttgcaacttatgcaagttatgattggattctaaatattgatagcgacgaaattttacaaccccagcttattcaagagatttctcagcttaatttcgatgaaccccacaaagtttacgcattgttaagaattaatcattaccgtggaaagccaataaaaacttgtggttggtatcccgactttgtgaaacgtttatataataaaaagttggtaaaatttgatgacaagcgagtgcatgaggcattagagattgcagatgatatacaggtagttcgcttaaagcatgaatttaatcattattcttttgatagtagtgagatgttgattaataaaatgcaacattacaccgctctttttgcggaacaacaaaaatatagaaagaaaagtagtgtattgtcagcaattgctcatggaatagttgcatttttcaaaagttatatattaaagagggggattttatcgggaggcgatggttttattatttcttttgccaacgccagcggttcttactataaatatattaaattaatggaagctaatcagagtttaacaactgctttaattataacaacttataatcgcccagatgccttagaggctgtgttagtatccgtattagcacagagccttttgccgaatgaagtaattatcgctgatgacggctcaacagaagataccaaagaacttattcaaaaatatcaagcaatttttcctattccacttaaacatgtttggcaaccggatacgggctttcgtgcagctgagtcgcgtaatagagcattgtctgttgtggaatcggagtatgtgataactattgatggggatatggttttacatcctcaatttatttctgatcaccgtaaagcggcagaaaagaatgtatttgtgggggggggaagaatattgctcactaaggataaaacgaccgcacttttacaatcatcagaacaatattcctcttttaaatggtatgaaaaagggcttgaaactcgttttgaaaaacgtttaatggcgttgcatattcctttcttgtctgaatttatccaaagaactaaaagagtgcattattacaagggtgtaagaagttgcaatatggcattctttttatctgatgctttagaaattaatggttttaataatgattttgttggttgggggcgtgaggatagtgaatttgtcgctcgtttttttaataatggaggaaaaagaaaaaacatcaagtttgcagcgattgcatatcacttgtggcatcctgaagaagatagagaagccttgccggttaatgatgaattacttaaacgagcaattgaagataaattggttttttgttcaaatggattgaaccaaattaaattggattaaatattattctttatatttttgtaacgcacttttcaccagggagatgtaaatagacttgctttttagctaaaaaagagtacaatcttcaggctttttgtctatatatacagagaaaaaagtaagcattcccactcttttgatgtgggttttcttttagtttaaattagttagaggaaggttatggtaaccattcgtttatctcgtggcggttctaaaaaacgcccgttttatcaaatcgtagtagctgacagtcgttcacctcgtgatggtcgtttcattgaacgtgttggttttttcaatccgttagcatcaggtaatgttgaacgtgttcgaatcaatttagatcgtgtgaatcattggattggtaatggtgcatctttatctgatcgtgttgctagcttagttaaagaggctcaaaaggcagcttaattttagcgattttataggtgaatgaaatggaacaacaaagaatagaagtcgttggaaaattaggttcaacatacggaattcgtggttggttgcgtctttattcatcaacagaacaagctgaaagtatctttgattaccaaccttggtttttaaaaatcaaggggcaatggcaaccaattgaattggaaagctggaaatttcataatcacgagttaattgttaaattaaaaggcattaatgagcgtgaggtcgcacaaactttggcaaatgttgaaatcggagtaaatttatccgtttttcctctattagatgagggggatttttattggcatgatttaatcggttgtcaagttgtgaatctacaaggttatgcaatgggtgttgtgtctgaaatgatggaaaccggtgccaatgatgtgttggttgtacgtgcaagtacaaaagatgcttttggtaaaaaagagcggttgattccgttcttatatgaacaagtagttaaaagagtggatctcagttctaaaactattgaagttgactgggatgctggtttctaacctcaggtaatctgtaacgctttggcagtaacataaacacagaaggtaagtaaatgtggatcgggattattagtctatttcctgaaatgttcaaagctattacggaatacggagtaacaggacgagcagttaggcaaaacctgctggagatacaatattggaatccgagagatttcacctttgataaacataaaacggtagatgatcgcccttatggtggaggaccgggaatgttaatgatggtgcaacctttgcgtgatgccattcattgtgcaaagtctgtggcaggtgatggtgtgaaagtgatttatctttcgcctcaaggacgtaaactggatcaaaatggtgttcaagagcttgccagaaatcaaaaaatgatttttgtttgcgggcgttatgaaggcattgatgaacgattgattgaaactgaaattgatgaagaatggtcaatcggagattatgttcttaccggtggggaattgccggcgatgacgttgattgatgcagtcgcaagatttgttccctgtgttttgggtaaacaagcctctgcacaagaagattcttttgcagaagggctattagattgcccacattacacaagaccggaacaattaaacggtttaactgtacctcctgtattgatgtctggtaatcatgaggaaattcgtaagtggagattaaagcagtctttgcaacgaacatggttaagacgacctgagctattggaaagcctagctctgactgacgaacaaagtaagctgttatcgcagattaaacaagaaaacagttaatcagttaaatctaggatctaagaaggattactacaatgagtaatatcattaaacaaattgaacaagaacaattaaaacaaaacgtacctagcttccgtccaggagatactttagaagttaaagtatgggtagtggaaggaagtaaacgtcgtttgcaagcattcgaaggtgtggttattgcaattcgtcaccgtgggttacatagtgctttcactttacgtaaaatatctaacggcgtaggtgttgagcgtgtattccaaacacattcaccaattatcgacagtattactgttaaacgtaaaggtgcggtacgtaaagccaaactttactatttacgtgagcgttcaggtaagtctgcccgtattaaagagcgtcttggtaattagtttattagacttatataaacaaccccttggatactccaaggggtttatttatagaaagattggcacgttttgacattaaatcataaaatacaaccattaatagaacattaagtaatatgatgaatgagcacatattacaataatgaaaaatgcaaaaattccacaaaatgatctgcccagtgtttttcatgatgaatttcatttgccatcattcgtaagcgaatgttatctaatggatgacctgtgcgtaataaggcttggtaataatggagtgtgcaatcaatataggcttggttcatatttgaaataaataatgaatcaacatcatctccttctttagtgcctacttgaataaagactttactatttttatcaattggattgtggtggataaaatgcagaaaatctttttcactaaaccaagacgcgagagaaaaaacacctaaatgtccaaaaatttgtggatatgctgaccccatataggcagtgataattcctcccatggaactaccagcaagcaaagtatgttctttttgtggtttagtgcggtaatgttgatcaatgaatggtttaacgatctcaactacccatttgccgtattccatacctttcccaccgcactttttaatttccggtgacgagcctacgtcagtacgccaaggtccatattcatcaaggcgatctacacctgaattatctatgccaacaataataattttaggaaattctttatggtgtttaatggttggaataattttccaagagtaacctgagtaagattctttactataaaaaatattttgtccgtcatgcatatagagtactgcataactatcccacgtatcggtgtaataatcttttggcaataacactcgaatacgacgagtgcggttatagtaggggacgtaaagaaaatgttcttccatttttaaataataattagtatttttcacaacaaaaaccttataaacgtaaaacaaagtgattttttaaatactttcacctaaatgaatattatatccgagattgatcatgtaattttcaggtacaataccttctatacgattcagtaattcttttgctgccacttcaccgatatttaagcgtggtgtgcgtactgtggcaatttgtgtcgttaaagataatccaacatttaacccatggaagcctgcaataccgatttctttaggtacgtcaattccttgacgttgacattcaaataacgcaccaattgctaaatcatcattggtacaaaaaatgccatcaatttggggatgtttttttaatgccagttttaattgttccgcacctaaagtaaatgatgagggttcttccgtgaggagactgtgaggtgtcagttgatgttttttcattgcttgttcgtaaccctgcatttttaaacgggtacgtttatccatacgagcagagaaatagacaatatttttatagcctcgtttaatcattgtttccaccatagactgtgctgccgctatattgttgaaccccaccacttgttgtaaaccgaattcgctggtatccataatttcgacaacgggaatatttgccacatctaacatttttagcgttcttgccgaatgttctgtttccgacaaaataagtccatcaatgttataagagagaagcgattcaattcgtttttcttctttttcttgacaataaccataatgggctaacatggtttgataacctgcttgatcggtaatattctcaatacctttaattacatcggcaaaaacatgatttgttaaagagggtacaagtacaccaattgctttgcttttcgcattggataaaatttccggtgcacgattaggaatatatccgaagtgttctatagcttcggcaatacgcacacctgtttttggtgcgacaagacgtggatcacgcaaataacgacttatcgtcattttagtaataccaagatgagaggcaatatcttgcaaagtggggcgtttacgtttatcgggcattttttatcctaacataactttatttctgtccattttgccagcaatatgcctgttgcaacagaaacattcaagccgtgttttaatggattaactaatgacaaattaatcagttcatctgctttatccgctaatgattcagtatcagcttcactcagtacaaatgcaactttatcattgagttgtaattgcttaatggttttggcgtgtttatttgagcttagatgaacgatttgatagcctgcttgtcgcaatttaaccaatgccgtttcagtgcgatcaatttccagcggatgaatatattccataccgccttctgccactcgcattgctactgcagaatgaagaagttcaacatcgtcaataacaaccgcacttataccataacatacacaagtgcggataattccgccaatattatgtgcattacgcacaccatttaaaaccaataggcagtttttttggtgtggaatatctaaatagccgtgcaaagtaaatggacggcgttttttgaccaacatgcaaataccaccatgatgttcagtgccgctgactaaggctaactcgctattatctactacatgatagacttttttattgctggctaaatagctaaacaaatcccccactttatgtgccatttctaccgtagtccaaacacgcacaatactttccggacgttgtgcaaaaagggataaacaagcattttcaccatatactttcatttcctctgcacgatttttcttgatcttctccggtgcacgtggcgataaagggccagttttcttttcagtttttgcaactaaacttgaacgttttagcacaacttgtacttgtcctgtaccgtttggcttttccatagtggtattgataatatgagtgtgggaagccgtattttgtgtattttgagggcgagagtgccgattggataaagctcgctttgagttattgtcaacgtgcggtgattttgatgtagatttttcatatcttttgttgctgacaaagcgttcagcaaagcgtttttcattatttgcttgttgaaaaattggtttttttgtcttcatgttggatattaatttaaggttagaaaaagataaagtgagcaaaaaaacaccgcactttatagagttttgtgaacattataacgaaaaaataccttttttctaccaagttaccgactaaatattgtaaactagccagctaaacacaaactcgtagagaagtgaattatgttgatcaataaaacaaaacgggcgaaacaaaatttggagcggttaccttgtattcctttgcaagcagagcaagttgagtttatttatcattcttcagattttaaacaacagattattcagtgtattcgtcaagcaaaatcaagaatttatttcaccgcactttactggcaaaacgacgaggcgggacagcaaatcctagatgagatttatcgtgctaaacaggcaaatcctgaattagaggtaaaaattttggttgattggcatcgtgcacaacgtaatttacttggtgctgagaaaagtgccacgaatgcggattggtattgtgatgaacgcagtaaatatcagttggctgacgatcctaatatattttttggtgtgccaatcaatactagagaagtattcggtgtattgcatattaaggggtttgtgtttgatgatacggttttatatagcggtgcgagcattaataatgtgtatctacaccaacaaacaaaatatcgttatgatcgttatcataaaattgaaaataagagattggctgatattttagtcagctttgttaagaattatttattcgatcctaatgtggtttatccgcttgattccggtgatcgtcctaaaaccaaagaaattcgtcagtatattcgtaattttcgtaaatatcttgccggtgagggacagtattatgtggaatcttcagtgaccttaaatgacagtttgacgatttgtccattatttgggttaggtgcaaatcataatttacttaatcaaaccattgaagatttatttcaagttgttgaggataagttaacaatttgtacgccttattttaattttcctcgtttattacagcaaaaagtacgccgtttgctggctaaaggaaagcaaatagaaattattgtaggtgataaaacggctagtgatttttatattcctccatcagagccttttaaaatggcgggagcattgccatatctttatgagaaaaatttgcgtcattttagtaaaaaatttaccaagcaaattgaacaagggcagttagttgtccggatttggaaagatggtgaaaacagctaccatctaaaaggcatttgggttgatgattgttatatgttgttgacaggaaataatttaaatcctcgtgcttggcgtttagatgcggaaaatggcttatttattcatgatccgaaacaacaattacaaacacaaattcaacaagagctgacctatattcttcgaaatactactattctaaaacattatactgagttaagtgatctgactcagtatccgaagccggtacaaaaaatattgaaaaaatttgcccgcattaaagcagataagttagtgaagatgattttgtaagggttattcaaagcacttcatttcaaatattaaccgatagatcggcgataaatttcgccgatttcttttgaactcttaccaaacaccttttctaattgtgccaaaaaaagctcaccggcagatattgcatcaataagtgcattatgaccgatatattcgggcaaattatatttattacgaatatggctaagttgataattattttcgttgtcctgacataacgaacgttcaatttttaaggtatctaaccaaaacagaggaaattgcgataaattatagcgaacgttcagataatgtaagataaaacgcttttctatagtggagccgtgagcaataagaatacgtccttgcatcagctcaaagagtttattcattgtatcatctagggtttctgccccatttagcatttgtggcaaaatatgattgataataacagtatcttctttaatttcttgttgctcggcgacgaattgatgccatgcttttgaaatatctaatgttaaattgtcaatgggaacggtagcgacactcaaaatattatccatcattgaattcagccctgtggtttcgaaatcaattactaagtaggaaagtgcggtcaaatctgtggaacttttggggtaaggcttttcaaataaccttttccattgcacgggtaaattatcttgattaataaagatttttcgctgtttttccaatttattcaacggatgaaatttgttgaggaaattttttatcatctcattattcctcgttgtgaaaaacgtatctctgccgcctcttgaaattgggcaattaagcgaaaagcatctttaaggtgatttcgttcaagggcacttaactcactgggatcgatatgattagttagttcttgctgttgttgcaatgcgtctgattgatatttaaaacgcatattgcagacaaattgatatacctccagtgcattattaagggtttctttattcagaataccttgcttgtaacaatgtctaaaacgctgttcagttgacatagtttgtgctaaaccggcagcaagtgcgtaaattcgtgcaagatctactaataaactgatagcacgttttttcaagttaagtttatttttatgttcaccttctttaataagaacaaaatttcggaaaatacttaatgggggttttactcgaatactgtttgccactaagaacgctaaaaagcgtttattgtgtgcgactaaatcgacaaaatattgctgaagttgatctgccaaattaagatcaccgtaaatacctcgcatatccataaatacagaggcattgagcaaaccttctaattcaggtgcaataatccaactacggaaattttctttccattcctgtagagaaacacaccagcgtgcatttattgccatatagttacccgtgcagtaaggatagccgcattcatgcaatccattgtttacaaatttagttagttgtacaaaatactcctgttcaagtgcggttaattttctttctaaaatgattgcattatcctgatctgataaagggtgcatttcataacgagcctgtgaacctgctacaacccaagcatagcgacagggtggagttcctaattcatgttcagccatcatgagcaacttacgggcaaatgcatcagcgataagcgtcatgacgtgcataatattattataagcgacacctctctctagtaaagcacggaataaatcccgttgctgtttagctatttctacaagcaaaggcagcgtatttgcttgaaaaatacggttaatgataaaaacagattgcatactgttttgttttacaagatctgtggcggttaaaataccttgaactttatcatcaacaatcaccggcaagctacgaatattatgttgcatcatcatggaaatagcttgtagtactaattcatcacccctaatcacaggaggattaatgttcatgatttctgtcactaacgtatttacatctaagccttgtgctacaacttttttggtcatatcccgatcatgaataatgccaatcaatttgttttgttgcatcactaaagcagaagaacggcgttgttcacacattctaatcgcagcttgttgtaatgtcgtattcgtatcaacaagagcaattttaggattagcaatatcaatcacttttttcatgaaaatatcattttgattttttaaaaagttattttttgccaaactgtttaatctttttcctgcatcagaagaaaagtaagaagcgtactcaggaaatttttttaaaagttcatttaagcgttgaaaaggaatttgataaattaacgtattttccaacgcataagcctgatatttatcttgctcgtgatgattgaaaatactgaaaccaaaacaatcgccactttccaatcttgctcttaattgtcctgatttattgacttgctccactgatcccatacgcacaatatacaagttttcattattattgaggctatcgatttcatcatttgtgattagttcccctttggggatataacgaatttcaatattctgtgcagcaagacgaattaaatcatgaggtaaatgtgtaaaagggggaacctgtgcaataaataattcgatattgggaataagtgagctatccatgtgagacctttgttttatcgaaagtgagctacaactatagcagaaattaacccgacacagctgtatcgggctaattacatttagtgtttttgagaagataattagtttttacgatttttccataatttaattaatcttctataacgctctgaggtttctttgatgagttgctcatcatcaattttaccagctaaccaatcagccgaaggttgtccaaaaattgttctgcctacagcaaacccttttactaaaggtgcgtttgccgacgctttaaacacattctcaaagactgcttcaggtgcgtctaagccaaggattaaaataccacgacaatgtttgtcatttttttcaatgacttgactgatgtctgcccaagtttttgcggacactccaggtaatttccaccaatccggtttaatgccgagagaatagaagtgggcaatcatatcggtgtagtaactttctttttgctccatatccgcaggcaaaatgatctctagtaataattcgtgacctgtacgacaacaagcacgataaacttcttttaatgttgcatcttgatctgcttttaactctgccttgtctgccggatgatagaatgctaaacatttaacgacatgttctgcgggccaactaatgagttgactacctaaatcaccatgctctaaacgcaatggacgagaagatggcatttctattggacgaccaatccaccattttttaccagtaatttcattgagtgcttcttgaccaaatgtggtatcagctaaaacgccggcattgccattataaatcccctctttttgagcggtttgttctgcggctttaagtaataacgttttgagtgttggaatacgtttcaaatctgcaccgcacttttcagccatatcaaccaattgtttacgatgatcaaaggcaaaaatacataaatcatgccattgttgcttgcgtgttgtaacacggtgtaaatggtttaattgttcgtctaagtccggtcgaggtaccgattccgcacgggagagataattatctaattcttctttagtcggcattgccggggcacaaccatggcgagagacgaccaacgcaccgcaagcatttgcataacgacaacattgctcccaactttcaccgttaatatagccacgtaataaacctgacataaaggcatcgcctgcacctaagacattcaaaacttcaacacgtacgccatatacattaataccaccgtcaatatgattcggaatatcgccctcaaagacagagcaacctaacgccccacgtttgcaaaccaacgtagcgttactgactttacgtacattttttaatgcagttagcgtatcagttgacccaccagcaatatgaaactcctcttctgtaccaactaagacatcaaagtgatgtaaaacttcttgtaaagattgtgtaacggcttcagagtcaataaaacgagtttcaccatcacccaatgaagttaatccccaaagtacaggacgatagtcaatatccagtaaacgttttgttccattacgacctgcgtattcaagtgcggttaaaaccgcatggcgagtttttggatgggataaatgcgttccggtaatagcaagtgcttttgccgaagcaatatattcttcatcaaaatcatcagcggtgattgccatgtctgcacaattatcacgatagaaaattaatggaaaagtatcttgatcttttattcctaaaatcactagagcagtcagccgctctttatccgtaatcaaatggctcgtatctacacctagacgctgcaattcctcacgtaagaaacgtcccatatgttcatcacctacacgagccaacatagatgattttacaccttgtacagccgttccataagcaacattacctgatgagccgccgagatatttagcaaaagagctcacatcctctaagcgtgaaccgatttgttgagcatataaatctacggcaactcgtccaagacaaataagatctaatgttttttcttttttcattgtgcttctccttgcgtgatgaagtcatcacaaaaaacggatatagaataaattattgtcttaaattgaaacatatatttcaaaaatgtctagaaataaaattaatatttgagatattgatcacaaagattagctatctcgctggtatataaagtcttttaagtaaaataagaatgaaatttccttttcaaagtggtataaatttaacttattactgagagaaatacaaaggaagagatagtatgcaagaacattctcaactcgttacattacaaaatgaaatctgttcacgttattcgactttgagtaaacgtttgaaacaggtagcacaatatgtccttgataatcacaatagcgtaatttttgatactgttgcgacgatatctgaacgtgccggtgttcctccttctacgcttattcgcttcgcaaatgcgtttgggtttagtggctttaatgaaatgaaacaaatttttcgtgaaaatttgattgaagaaacggcgaattatacggagcgtttacaagtttttcgtcagctggaaccggaaaagagcgagcaacataatctgcaagatattttgaatatttttgcacaagccaataaccaagcactaaaacaattaagtagccaaactaccacaaaacagttaaaaagtgcggtagaaatattaaaaaatgcacagaatatttttatcattggattaaaacgttcgtttagtattgcctgttatttggattatgtgttgcatcatttagattgtcgttcttttttaataaatggattaggcggcatgtttgatgaacaattaatgcaagtgaaaaagggtgatgtcatcgtggcggtgagtttttcaccttatgccaaagaaacgctggaaattgttagtgcaacctcacaaaaaggtgtcaaacacattgctatcacagacagtcaaatcagcccgttaattgcttccagtgatgttgcttttgtcgtgaaagaagcacaagtaagcggtttccgttcacaatgtgctacgatgacattggtacaaactttggcgattttattaggcttagaaaaagagaaagaaacacaaaattcttaaaaataacgattaagacttggtgatgaatgtcagcaactaagttttgagataaatatcaaaacgatgatttttggtttggtgactgaagtgcggtgtttttttagcaagaaaatctgcgtaatcgggacgctttactaccgctcttttttgtgcgagcaataaggcaggttctaataacatatcagcatccaaatctgcaccgattaaatgttgaaaaatacgcatttcttttttaaccaacgcacttttttgtttatgaggatacatcggatccaagtagacaacatcagcaccttcttcactcgaatttaattcttgaatatgtgctatgtccagcaattgcatattcgcctgcatcatagtccctatttccgcatcggcataagcacgcttcaagccgtcttgtaataacaaatggactaccggatggcgttcaaccaaacggactttacaccccaaagcagccagcacaaaggcgtcacgtcccaaaccggcagttgcatcaataactgtcggcagataattacctttgatccctaccgcttttgccacagcttcagctcgaccgcctccaaatttacgacggtgagccattgtgccggtcacaaaatccacataaacagcaccaagtttcggctcatctaatttgcgtaattccaagcgaacctgtccttccacttttgtttgcaccagtgctaaataactattaggatcgtgaatcaaacctttttgttgacaaagtgcggtaaattgcaccgcactttctgtttcacaaattaattggattttttgattaaccatacaccactttccatatgctctgtataagggaattgatcaaacaaggcggctttttcaatacgatgagttttagttaattcttgtaaattttcacataatgtatatggattacaggatatatataaaatccgctcatagttttgtactaattttactgttgccatatcaagtccagatcttgggggatcaacaaaaatggtattacattgataatcttgtaaattaatgccttttaagcgattaaatgcacgcacaccgttcatagcttgcgtaaagtcctctgcggacatacgaataatgtgtaaattatcaattttatttgctgcaatattaaattgagccgcacttacagagggttttgcaatttctgtcgctaatactttgcgaaagttttgtgctagggcaatagagaaattgccgttcccgcagtaaagctcaagtaaatcgccctgactatttttagtacaattaattgcccattccaacattttacaatttaccgttgcattaggttgagtaaagctgttttctacttggcgataaatatactgttgatttttgacaggcaaaatttcatcaacaaaatcttgctgtaaacaaattttttgtttatttgcacgaccaataatttgtacatcaaatccttgttttatcagttgttgtttcaattgagttgctgcctgtagccattcttcgttaagtgttttgtggtataacaaactgacaatgatcttgttgctcaaagtactgagatagtcaatttggaataagcgatgagttaaaatattgtgttgtttaagcaaaggcaataacgccagcatcatttggttaatcaactgactggcaataggaaattgatcgatacgaaaacgttgttttgttttttgatcaaacataatatgatagaaatcatcttgttcatgccaaatacgaaattcggcacgcatacggaaatggcttgtttcggaagcaaatacgtcaagcggtggtgaattaaaaggtgctagaagtgcggtcagcttttgttgtttttctgctaaaagtgcggaatattgttcaataggtaaacgttgcatgatcttcagtattgagctaaaaatgaaaaggtgcgaatttcgcaccccttttacttaatcttaagttattcggcagagaaatcatccggattgtcagcaccaacaacgcctgataatgtgtaaacacgtttactggcagaaatacgagtgcggtatttattccaagttttctcaaaatatgtttctgccgggcgttctccacgacagaaagcaacgaaagctttttcttcttccgtaactggtacacgctcacctaaatctaacgctttaaatgcttgaccatattgctctaacgtttgagattcacgaatggtgtaatcaccatgacgagcaaaacctcgtggataatttttatcatcgaaaaaacgacgtgtaacactaaaactctctgccataatatcctctatcttattttgtaaaaatcggctcgcattaaatcaattttttgttatttttgcaataaacctttaacagtttctacataatccttgataaaaccgtctgttgtacgggataaaccttctgagtttactttatatttaccgttaatataaaattcaggtgttgctcttacgccaagtttttttgctaaggcaatttgtttgtttgtttgagcggtgacggcaaaactattaattcctccgtcaaactgtgccgcagtaataccgtttgcgagaaacacttcacgaatattgtctaaagtaggtgcttttcttttttcaataatcaattcaaatagaggcattttaactttttcttctatgcctaagagaattgctaatgaccaagcacgaacaatatcttcgcccatccaatcaacatgatattgtttgaaagtgacatctttgggcaaatcagctttaatttgttgtggaatttgatatgttttttcaaaattaaaacaatggatacaaccaaaagagaaaaattcaatcacttcaggttgaacggaacgaggctgctctagttcaatatactgttttccttcttgtaatactaaggcttgagttgaatttaaaaagaaaaaagaggctaatgcccatagaaattttttcatgtaatactcctaatcaataatgccacgtgcttttaataaggctgttttaaaatcgtcttcataatcttttttgatgccgggaataggctcatttttatctgtaccatacatttttaggtgataaataataacctcgtcggttaattccgcaatgggcttatcaaaaccggtttcctctgcaattttttgtaaaacttggattaaatgtaaatccggattgttagaccaatagggctgtaaaagttccaacacttcgtttaaacgatgacatttcataaagttttccttattatttaacccaaacagccgacaatcatacttgaaataggtaaagaagaaaatatggcaacaacaattagtgcagtaattttagctggtgggcaagctaaacgaatggctgggttagataaaggattacaactgcttcaaggtaagcctctctatcaacattgcttgcaaaggttaacccatcaagtgagtagtatttctattaatgctaatcgtcatcaagctatttatcaacaaagtagggtagaggtttttggtgatgaattggaggattttcaaggtcctttaagtggaatattgaccgcacttgagcgagctaatacggattttgtgctttttgtgccttgtgatagcccttttttgccgttgaatttatgtgaaaagttgcaaagtgcggtggagaattcgaaaagtttattagcttatgcaaatgatggtgaacgtgaacatcctgcttttagtttattgtccactcaacttaaattaccgttaagagcttatttgcagtccggtcatcgtcaaatgttacaattttttcgtcaacataagggtatttctgtggatttcagcttacaaaaacaggctttcgtgaatataaacacattgcaggatattgaaaaatatcaaaatatttatgcttaattttttgttttaattattaattaccttaatttgatcataaatatatgaaaaatcattttttttactaagcaattagagtagacttcccctccgttgatatattacataggaataaaaaatgttaagcaaacaacaatcattaaaagaactcacatttcgaggaatgttattgggggcgttgatcactgtggtatttacggcttccaatgtatatttgggtttaaaagtagggttgacttttgcctcatcagttcctgcagcggttatctcaatggcagtattaaaatttttcaaggggtctaatattcttgaaaataatatggtacaaactcaagcatcttcagccggaacattgtcttccgttatttttgttatccctgctatgttgatgctgggatattggcaaggtttcccttttgggcaaacattattaatttgtatttccggcggtatgctaggggtaattttcactgtgccgttgcgtaatgtcatggtagtgaaaagtgatttgccttaccctgaaggcgttgccgcagcagaagtattgaaagcgggtaatgatgaaatcggtggaagaggtgtcaaagaacttacaatcggtggtctgattgcagcggtagccgggtttttaactaatggtttacgtgtaattgcggatagtgcaagtctttggttcaaaggtggaaatgcaatttttcaagtgccgatgggtttctcactcgctctgttaggtgcggggtatttagtgggtatgattggcggtttagccattttattaggcatttttgttgcttggggagtagcagttccttactttacttctgtcgctcctatgccagctgatgccgatatgataggttatgctttcagtatttggaaaaataaagtgcgttttattggtgtagggactatcggtattgcggcaatttggactttattggtgttaatgaaaccaatgattcaaggtatgatcgagtcatttagagctttgaaagatccgaatgcaaaaaatactgaccgcacttcccaagacttatctccgacaacgctgattttcaccacgttagtaagcgttgtattaattgtattggctttatatagctttataaatcctgtgggtattgaagccggcacggcgatcattttaattttggtttgtactttacttgctgtcgttatcggtttcttagtagcagcagcgtgcggatatatggcaggtcttgtgggatcatcatcaagcccaatttccggaatcggtattatttctgtggtaacaacttcattagtgttaatgcttgttggttctgctacaggtttattagacacggcggaaggtcagaaatttttgaccgcacttacgctatttaccggttcaatcgtggtttgtattgcggcaatttctaatgataacttacaagatttaaaaaccggtcaattagttgaagcaacaccttggcgtcaacagtttgccttgattatcggtgtgattgtgggggcgttggttattgctcctgtattggaaattctttatcacgcctatggttttgccggtgcaatgcctcgtgaaactatggatccgagccaagcacttttcgcaccgcaagcaaccttaatgatgactatcgcaaacggtattttttctcataatctcgaatggaactatattttctttggtatcggctttggtacggttttaattttcatcgacagcgtattgaaaaaggcgtctaacaaacgtttagcgttaccagcattggcagtaggaatggggatctacttaccgccgtcagtcaatgcaccaatcgttgtcggtgcattgcttgcttggttgattaatcgtcatttagaaaactttgcgaaacgtacaggcaaagatcttgctgatgtgaagaaaaaagcggaacgtttcggcacattatttgcagcgggtttgattgtgggtgaaagtttaatcgggatattactggcatttattgttgcaggttccgttacttccggaggttctgatgcaccgctagcattacatttagaaaactgggagagtctagctcaagtattaggcttaatgatgttcgctacgggtataacaatctttgcattacgtgtactcaaggcgaaacaataatattgcgaaaattaaataggacttgacaaaaaacctccagctttagaaagcggaggttttttctacacaattttgaaacaagaaaactaagtaatattcacttcataacaatacctaacgattaacgcacaccctgtttatctaatctggcgaaatctttacatccttgagcgttgccgttatcacatgcttgaccgtagaatgttttagctgtagaaacatttttttgtgcccctcgtcctttttcatacatcacgccgagatagagttgtgcttctgcaatgccttgttcagcggcttttgtgaaccaatagactgcttgttgatagttttgagcaacgccttgtccgtttgcatacatcacgccgagatagagttgtgcttctgcaatgccttgttcagcggcttttgtgaaccaatagactgcttgttgatagttttgagcaacgccttgtccgtttgcatacatcacgccgagatagagttgtgcttctgcaatgccttgttcagcggcttttgtccaccaatagacggcttgttgagagttttgcgtaacacctagtccgttcgtatacataaagccgagcatagattgtgcttttgcatctccctgttcagcggcttttgtgtaccaatagacggcttgttgagagttgtgtgtaataccctgtccaaacatatacattgtgccgagcacagcttgtgcttttgcatttcctttttcccccagttgtttgagtaagggaaaagcggcagaataattttgttgtttgtaaagttgagtagctcggtcaagtttttcgctattggtttcggcaagtgcagattgggcaacaccgaaagagagcaaggcgataagtagggatttttttaggttcattttatgttccttatttgacgattatttgaattcaatacacaaagtttgtggattgagaaaacattttcttcccgtttcaagaggggtgattggattcaaaatatttaaattagaatcaaataattgagagctgccattagcaatcattttattgacgatttcatccacctctttttgttcattaggattgatggcttttatattgtcgtaaacataaggcgaatctgaggtatctccaaaaaaattcttataaataccaacagtaatttcaatacgatttgacatggttttttcctctgatttgattttatatgtggcgttcgctacctactatcaagtaggtaggatgtagagtatactctacatcctttgacgtcctcccctagctaaagtaaggagattcctaccagctcccacagcaagctgtgggctactctcggagggtttctgctgctgaccgccaatgcgattcacttcacagacgctacgggcacgtcctgccctgattatgccgtcattgagagtctaaagcgacctctgttagcagtaagaagtatatcatatttgtgccttatatccatgccctaaaggacgtggttttatggcacgattagataaaggattgctaaaccctttgctcggtgtcgattggtctattgagtgttatttatacagcagtatattaaaaaacaactccggtttgaaaaccggagttttttatagatattaggcaaaagtatctaaatattgatctgttatttgggagacttatttgactagcccgccacttgcttgtaagtcagcatgatacgaagaacgcacaaaaggtccgcaagcggcatgctcaaatcccattttttcggctttatcacggaaatcatcaaattcctcaggtggaacgtatcgggcaacaggtaagtggtggcgacttggttgcaaatattgacctagagtcaacatggttacaccgttatcccgtaagtcctgcattacctgtaaaatttcttcattggtttctcccaagccaaccataatgcctgatttggtagggatatgtggaaaaatggttttaaattctttgagtaattttaacgaccaattatagtccgcacctggtctgatttcacgatataaacgaggtacattttctaaattatggttaaaaacatcagggggattatcttttaatttttctaatgcttgctcaatgcgtccacgaaaatcaggcaccaaaatttcaattttaatacatggattaagtttgcgaatttctttaacacattcagcaaaatgtcccgcaccacgatccggtaaatcatcacgatccactgatgtaataacgacataacgtaatttcatatcttgaatggtttccgccaatttttttggttcatccggatctgggggtaatggttttccatgggcaacatcgcagaatggacatcggcgtgtacaaattgcacctaaaatcataaatgttgctgtgccgtgattgaagcattcatgtaaatttggacaagacgcttcttcacatactgaatgtaatccatgacgacgcattccgtttttaatactgttaattttcgcagaatttgcaggaagcttgattttcatccattcaggtttttttaataactcctgatttggatcgatatttttaaccggaatgattgacgtttttgcagcatcacgatatttgacaccacgttccattttaaaaggggttgtcattaacagatcctaatttgttaataaattgttacatcattatagcccaataattgcgtaaagtgtgtaactaatttgggtgcaactttatcacattgagcttgttcagtgggtataaaatctgccatttggcacatttctaagcctatatagccacaaggattgatttgtctaaatggcgataaatccatgttgatatttaaggctaaaccatggaaagagcagcctttacgaatacgtaaaccaagagaacaaattttttgttcatttacatatacaccgggggcatcagctttcggataacttttaataccataatcagccagtgtgctaaccactgattgctcaagagcggtaactaattgacgaacattaagttcactgccgtttgctttgtgacgcttaatatcaatcagtacatacataatttgttgtcctaagccatgataggtaatttgccccccacgatcggattgtaccacaggaatatcggttggattgagcaaatgttcaggtttacctgcttgtccttgtgtaaaaacagccggatgttgaactaaccaaatttcatcagctgttagcacatttcgagtatcagtaaattctcgcatttgttgccaaacttgttgataatcttggattccaagttggcgtataataagagtagtatctgtcattttctgtcttaaagtaccatgcgtacaccatcaattttggctagttcagtatagagaatttctacttgttcaatattttccgcaatgatatctacagaaattgaattataagttcctttgctactgatattttgacgagggttataatcacccttagcgtatttttgcgttaccataactacatcatcaattaaatctgctcggtttttaccaacgactttgaaagtaaaagagcaaggaaactccaacaaatcttttaattgtttttgtggaatgtcgttaagttttactgttttgtcagtcataaaatttccttaaagtgaaaatatgccggaaagtgcggtctgatcttattgttgttagttaaacaaaccttttactgttaataccagccagtcccaaagtttgctgaaaaatccgccttcttgaacttcagacataatttttaagtttgcacttgcaatattacgaccatctaattgataaataattttacctacaatttgtccttttgctaacggagctgttaacattttttgattaagctcgtatcttgttttaacatcattctggcgagctttaggtaaagttatataagcatcttccagcaccccaagttgcactttgtttgtattaccgtagtaaactttttcttctacaatagattggtttgcctgtaaagatttgaaggtttcaaagttagcaaagccccattgtaacaattttttactttcaatttcacgacctttgtgagtagcaacgcccataacaactgaaattaatcgcatattgttattatttactgcagaggcaaccaagttataacctgctttatttgtatgccctgttttcataccgtctactttgattgatttatcccaaagtaaaccgttacggttatgttgcttaattttattgaaggtgaattctttttcagcatagattttatattcttcaggcaggtcatgaataatatgacgaccaataatcgccatatctctggcagatgaatattgattatcatcatccaatccatgaacggtcataaagtttgtattttttaaaccaaatttagcaacatatttattcattagttcaataaaattacgctctgaacctgctatatgttccgctattgccacacaggcatcattaccggatacaatcactatgccacgatttaaatcagctactgatacttgttggtttaaatttaaaaacattttagatgaaccgggaaaattttcccccaagcactttcatcaatggttacagtgtcggttaagctaattttaccttgcttgattgcatcgcctacaacataacttgtcatcatttttgttaatgaggcagggtgttgacgctgatccggattaaaggcagcaagaactgcacctgaatggtaatccatgagaatatagctttgtgcacttaattccggtgaagcaatgccatattgaatatcttgggaaagtgcaggtaatgaaattaatcctgacatcagtgcaatttttgtttttttcatcgctttttgtaacattttacgtcctttaaaaattatttctcattgtaagagatggtgataaattagtgtaattggcggatttatttaacctatctttaaaaccttattgctaagatttaatgtttttacgtgttttagccaacgtttttgtacccggtccggaaatttttccataagcatcaacatataatgattctacctttacttttgctatgccggcatgaatcattccaagctcttttgcggcagcttcagataaatcaataattcgtgctttgctaaaaggtcctcggtcattgattcttacgatcactttacgattattgcgtaaattagttacgaccacataagagtttagtggcaaagttttatgtgctgctgtataggcattattattaaaaatttcaccgtttgcagttttacgtccatgaaattttttgtgataaaaacttgccattcctttttgtgaataattttttgccttttcgtagggtagtgttgtatatctaacgcctttgactacgtaagtatagggctttttactcagtttttgatagactagcttagctccttcaatgccatataattttttcgtatccgcctgtattgacagcgaaactaatgccataaaaagtgcggtgcataatttaaatattttgtttgacttcatagtaataagtttaatattgattgtattatctaagataaatatttatttagttcctttgaaaaagttatttttatgtgtatgaatggacatgattaaaccaaatccagccattaaggtaacaaaagaggttcctccatagctcattaaaggtaaaggtactccaactacaggtagaatgccacttaccataccaatattgacaaatacataaacaaagaaaattaatgtcaatgcaccacttaaaattcgtccaaaagaattttgtgcattaacaccgataattaaccctcttgcaacaataaagagatagatgagcattagtattgtaaatcctgtcataccatattcttcacttaatacagcaaaaataaagtctgtatgtggttccggtaggaattcaagttgcgattgtgtaccttgcatccaacctttaccccaaatcccccccgaaccgatggctatttttgattgcataatgtggtagccagcacctaaaggatctttttctgggtctaaaagagttaagacccttgtgcgttggtaatcatgcattaaatagagccatacaattggagtaaaagcagctaagcccacaatagcaattaagatgaaccaccagttgattccggctaaaaatacgacaaaaatcccggatgcactgactaaaattgacgttcctaaatctggctgaatagctactaataaagtcggcactattattaataataaagcaataaaaatttcacttaatttaggtggaagaggacgttttcctaaatatgttgcaaccattaatggtactgataatttaacaatttcagagggttggaaacgaaaaatccctagatctaaccaacgttgtgcccctttacttgttgttccaaaaagatccactaacagtagtaaaattacgccaatgacaaatccataaggtgcaatacgttgataaaaccttggtgaaaattgtgccatcacaaacataacagtaaaaccgagagcaacttgaataattcggttgcggaacattttttcactgcctcctaccgcactataaagtacaagcaatccataggaggaaatggttactaaccctagaaaaagccaaaaatcaatatgcaaacgacgccacaaaatcagccaaatattttttttctccatcaactttttcctttttcatttttcctttttcattttgtaattgtacttgtggcaaacggatatttaaataatagtccataatttttcgaacaacagggcctgccttactgctaccaccaccggcattttccaaaataacaacaacaaccattttgggatcgtcataaggtgcatatccgatgaaccaggcatgatcgtgcaatttattatcaagttcgtttgcattgtaagtttgattttctttcaggctgaaaacttgagctgttcctgattttcctgcaacaggataactgacatcaataaaagatttacgtcctgtaccattcggtgcgtgtattacattatacatgctttgttttatcgtttcccaaaataccgcttgaggttcagtaatatcttcgtaaagacgaggatcttgatagggttgcatttctgacccttcaactgctttcattaagtgcggagtattaaccttgccattattaactaaaactgcagttgctttggcaacttgtaatggggtggctgtccaataaccttgaccaattcctacagaaatagtatcaccctgaacccaaggtcgtttgtagcgtttttgtttccattcccgacttggcataagtgcggcggtttcttcttgaatatcaatacctgttggtacaccaaaaccaaagcgtttcatccactgagataaacggctaatgcccatgtcgtaagcaagttgataaaaataagtatctgaagattctactatagctttattcaaatcggtgtagccgtgccctgattttttccaatctctaaaacgtttggtggtattaggtaaaatccaatatcctgggtcaaatatcgtagtatttgtggtaattaaattttcttgcaagccagcgatagcaacgaaaggttttatcgttgaagccggtggataagcaccttgagtcacacggctatacaaagggcgattaggatctgtcagtaattgcttgtaatccgcacttgaaataccgccaacaaaaagattgttatcatagctcggggtagaaaccattgctaaaataccgctatctttaggatctaatacgacaactgctgcacgaagattgcccaataaatttgcgatataacgttgtaattctaaatcaatcgttaagtgaatactttttccggcaatagcaggctgttcccttagtttgcgaataaccttacctctattattcacttcaacttcttcaaatcctactttgccatgtaagtcatcttcatagtaacgttcaataccgagcttgccaatatcatgagtgccggcgtagttggcgtatttttcatttttctttaaacgctctacatctttttcattgattttagcgacataacctagaatatgagtcaacggctcaccatacaaatagtggcgtttaaagtaaggcctaatatcgaggctgggatagtgatattggtttactgcaaagcgtgcgatttgttcttcgcttaaatctcctttaaggagaattggcatatatcgagatgagcgacgacgttcctttttaaagttctcaatatcatcatcatttaaaccaacgatatagcgtaactcttcaaaagtgcggtttaaatcctcaactttttccggcacaatatataagccgagaaaggtaatattttccgctaataatttgccgtagcggtcgtaaattagccctcgagtcggtggcaaaggaagtaatttaattcgatttccgttagatcttgtctggtaagtttcgtaattgacaatttgtaaataatacaaattggtaaataaaagtgctgataaacccaatacacctagaaaggcgataagagcacgacgagcaaaaaggtttctctccgcctttttatctcggatcggtgtttgtagaggttgagagagtaatttttttaaattcataaaatattaaccgcacttattctcggtgataaggatgatttgtgcttaacgaccaagcacggtataaactctcagccacaacgatacgtaccaagggatgaggtaaagttaaaggcgaaagagaccaactttgttctgtcgcagctttgcattcaggtgataatccttccggaccaccaattaagagtgcaacatttcgaccgtcatgtttccatgcttctaattgctgtgctaattgctcagttgtccaaggtttaccgggaatatctaaggtaataatacgacttttctgacaagcggataacatagctttaccttcttgttcgagaatacgtttaatatccgcattttttccacgttttcctgccgggatttctattagctcaaaaggcatatctttgggaaaacgacgttgatactcctcgaagccttttgtgacccaatcaggcattttagtgccaacggcaattaattgaattttcatagattaataagtgcggtcattatccccaaagtttttccagctgatacatttcacgactgtcagcctgcataatgtgtacaatggcttgaccaaaatctatcgcaatccaatctgcggtagatttgccctcttcgccaaaagtatcaatgccggcttgcttactttcatcaattaatttctgtgccaaagagattacatggcgacttgacgttcctgtacataaaatcatgtgatcggtaatagaagatttacctctaacatcaagggctaaaatatctgtgccttttaaatcatctaatttactcactagaaaatcgactaagttcattttttctcttctcaattgcttatggttatttgcttaaaagtgtgtaatgttagcatgatttgggggagctaggaatatcgtttgatagtgtaattatatacaaagaacgctcttttacttatataaaaaatttttctgtttataaatgatttctcggacagcgattggaagagatgagcgtttatttattatttaggttcacaaaaatcttttatgtcagtaatgccacatacattgaaagcacatctgtattggttttcactaatgttctttataaagaaactgcacctattaatggtacagttgtgttttgtcaaaaatacaaagtgataatgtgtaattctaaatttttctaaatattaactacacgcatcgcgatatatttactataacctaaggcacataaaaaaaggcttgcttgaagtaagataatacaaggtcctgtggcgacgttgaaatgaaaactgagcaatacgccaaaaataccactgaatactgctgtgcaaacggcaattagcatcatataatcaaagcgtttagctaaaatatagcctgttatcccaggtgtaatgagcattgccaccactaaaataacgccaacaacttgcattgcactgatgatgactaacgctaggattaccagtaaaccatagtgtaaaaatttggtgttaagtcctgcaactcgtgtgtgacttggatcaaaacagtaaagcaacaagtctttgcgttttaaggcaatcaggataaatgccagtagtgcaatgccaatactttgccaaaattcttgcttaatgatacctagaatatttccgaacaaaatgtgcattagatgttgatcggtttccactttggaaaacagcaccaaaccgaaagcaaacattcctgaaaaaacaattcccatcactgtgtcttctttgattcggctgttatctctcaaataacctacggaaactgcacaaaagatgcctgcccaaaatgccccaatcgcaatcggaattgctaatacataggcaagaataattcccggcaatacagcgtgagaaatggcatcacccattagtgaccagcctttaagtactaaataacacgataaaatcgcacatactgccccaatgataggtgcgatgataatagcttgttgcataaatggatacaccaagggctcggtaaaccacgctacaatcgtattaaacatttggcttctcctgatttgcaagatttggtgaggaagtcactgctttttgtgtacttcgcttacgtggaataagaccatatttgggagcaaaaaagaaagcaagcaagaagatgaacgtttgcaatgatacaataaagccaccagttgcactgtctgcgaaataactcaaatatgctcctagtgagctagtagtaccaccgagtaaaatcgaaataatcaacaggcgatcgaatcgatcggtgagcaaatatgctgttgctccaggtgtaatcaccatcgcaattaccaaaatagcccctactccttgtaaggcggttacaatgcatgcacttaacaaggtaaagaataaaattttgaattttaaaggcgatagccctaccgctttggcttgaatttcatcaaagaacacaagcattaggtctttccaaaagagtagcaacaatacaaatgatataccgagaataatagcgacttggatcatatcttcatcggcaatacctaaaatattgcccaaaacaatagattgtacgttcacggaagtgggattaattgaaataatcaacaatccgagagcgaagaaagaggtgaaaataaaaccgattactgcatcctctttgagtttagtcacgtatttcactgctaaaatggcaatagtggcaagtagcccagagaaaaaagccccgacggcataaggtaatgccaaggcataggcaatagcaacgcctgggacaacggcgtgggataacgcatcaccgatcagtgaccaacctttcagcattaaataagcggaaagaaaagcacaaaccgctccaatggcaccactgaccacaatcgccttaaacataaaatcataagaaaacggctcaagtaatagctctaacatcgcattactccgcatcttgaataaaatgttgataacgtaaaacgccaccaaacacacgagttaaattttcttgagcaaaagtgctttcgattgatccagcagcgagtagtgtacggttgatcatcaccgcttgatcgcaaaaacttggcacggtgctaagattatgcgttgaaacgagaatgagatgaccttcctgacgaagctgtttgagtaacgcaatgatggcattttctgtgccaacatctacacctgtgaaaggttcatctaataaaatgatttggctttcttgtgctaatgcacgagcaagaaatactcgttttttttgccctccagaaagctcgccgatttgtcgatctcgcaaatgagcaatattgactcgctccattgcgtctaaaacttttttcttgtcttgtgctttaggcatacgaaagaaattcatataaccataacgccccatcattacaacgtcataaacagaaacggggaactgccaatccacttcttcactttgcggtacataggcaattaagttttgttttaatgcccgattagcgggcatgttacaaatttcaattgaaccttgaggcttcactaagcccataatgcttttgaataaagtcgattttccacttccgttaataccgagcaatgcacaaatcgtaccaccttcaaggtggaaactcacatcgtgcaacgccgtatgaccattactataacgaaccgtaatatctctgacagaaagagaactgatgtgagttttcattcaattaccttattttttgaaaccattcacaatggtcgaaacagttacatttaataagtcgatgtaagttggtactttaccatcttttgtagaaagtgaatctacataaagtacaccaccgtattttgcattggtttctttagccacttgttttgctggcttatcagaaatggtgctttcgctgaacacaacagggattttgtgttcacgtacttttttgattacatttttgatttgttttggtgtgccttgttcttcagcattgattggccataaataaagctctttaaaaccgtagtcgtgagctaaatagctgaatgcaccttcactagttactaaccaacgttgtgaagctggtactttttctaactcagcacgtaatggtgcgtctaaagcaacgattttatctgcataggcttttgcattagcattgtaagtgtctgcatttttaggatcgtatttcactaaagcttcacgaatgttttcgatgtataccaaagcatttttggttgacatccaagcatgtggattcggcatacctttgtatggaccttcgtagatagaaattggatcaatccctttagttacaacaacagctggtttatctttcacttgggtaaagaaacgctcgaaccaacgctctaaattcattccattccaaagcaccaaatcagcagattgtgcttttacgatgtcttgtggagttggttcataatcatgaatttctgcacccggctcagtgatcgactcaacaacagcagcatcaccagcaacattctgagcgatatcttgaataacggtaaaagtagtaactactttaaattttgcgtaacttggtaaactgaatacagaacctaagattacacccataacaataagtaaacgtgacataatttctccttcgaattaatattagaaacaaatttgcatttcaagcaaactcggtcttgcatagtactgcaaaaataacttattgtaaatagcaataattatcaattaaagacattttattggtttgggtaaaccagctaattttgaagcttgttttgcgggaccttctgggaataaacgttgtatgtaacgactattgcctttatctgcacctagcttttgtcccaatgctttgactaacattctcattgctggtgaggttttatactcttgataaaaatcccttacaaagttaataatttcccagtgggcttcggttaattcgatattttctgattttgcaatggctatcgcgacatctttattccactgattcatatctaatagatagccctcaacatcagtttcaatttgaacttggttaacacttaacatatgttactatttttgtccttttgatatataaaaagtaaaaagcccctattcaaggggcataaaacaagtttaatcaattattcatcacggttgaaaatacctagtaaattgagcaagctgacaaaaagattgtaaagtgaaacatacaaactaactgtagctctaatataattagtttctcccccatgaatgatattgctggtttcatataaaatagccatagttgagaaaacgataaataacgaactaaatacgatatgaaagccactcatattaaagaagaaacttgctatcatgcctataaccaatacgataaagagagctagcatcatgccggataagaatgacatatcttttttcgttgttagcacataggccgagcatgtaaaaaatacacttgcagttccggctagagcaagaacaaccaaatcacctaatcctgagccaacataatagcttaaaataggacctaaagaatagcctaataatcctgttaatgcgaatgtagataaaagtccccaagcactgtttgctaacatattattgaggaataataatccataaaaacctaccaacatgacaccgaaatgaagtggagggagatttaattgcattgcactgaaggcgacaacagcagaaaaagccaatgtcaatgctaataaaaagtaggtgttacgtaaaaccttatttgttgccagtaccgattcttctttagtatcaacaataaaacgagattgcataaaagctcctaggttgtagttgtaaataaaaagtgaaaagctatttataagttaatggttagcaactttaatgtcaacatgaatatttttcagaaaagagtaacattgaagtaaaattaagtaaaaatggataaattatcaactcttaaaccataactgttatttttttagtttacttctatttctatctatattatattacgcctcgtcaagacggaggaatggtcgagtggttgaaggcaccggtcttgaaaaccggcgagggtttacgccctccgtgagttcgaatctcacttcctccgccatmaagttttactaagtcgtaagttatgcctytgaaatcagtaacttacgrcttttttatatcaggttaattgtcgtaataacttgcttaaaaatcaccgcacttattggtctgatagtttccgtagcaaacgatccatggctcgatagcttaatgcttcagctaagtggttttgtttgatatcagaatctccgtttaaatcggcgatagtgcgtgcaacttttaaaattcgatgataagcacgaacagataaaccgagtctggttaaagtattttctaaaaatagtgcatcttgctcagtcaacttgcaatctcgctcaatttctttaccggttaaataagcattgacttttccggctctagctagctgaatttctctgacccttaatactttttctttaacttgtgctgttgtttcacctcgatcttcggtattttgcaaagcaccttgtggaagtaaaggcacttcaatggaaagatcaaagcgatctaaaaaaggaccggaaagtctgttcaaataacgcaacacttgttgtggtgaagtgcggttgtgtataccggtataatgtcccgttggacttggattcatcgctgccactaattgaaaacgtgccggaaactgaatttttgcattcgcacgtgaaataattatttctccgctttctaaaggctggcgtaaagcatccagcactctccgttcaaattcgggtaattcgtctaaaaataatacaccgttatgagccaaagaaatttctcccggtttcggaattgttcctcctccaaccaatgctggtgatgaggcactatgatgaggtgcacggaaaggacgttgtttccaattttgaaaatttaattcgttttgtaccaaacttgttacagaggcggtttctattgcctcttgatctgtcatatccggtagcaagccagttagacggcttgctaacatggttttacctgtgccgggcggtccgagaaacaacaaattatgttgtccggcagctgcaatcattaaggctcgtttagcatgttgttgaccaataatatccgtcagatctttattagattgaggtgaaaaatccaccgcactttgcatacataacgttgtggatgaaggtagcgaactgtcgtcattcaggaattgtacgacctccaataagttccgtgcaaaaaatgtttcgtgttgtgaaactaaagaggcttcattagcattttgttgtgcgacaataagttgacgcttagatttttgccccgctaaaatagcagggatcacaccgtgtacgcctcttaactcacctgtgagagccaactctgcaacaaattcaaattgttgtaacttttttgcattaatctgttccgaggccgctaagatgccgagtgcaataggtaaatcaaaacgccctccctcttttggcaaatctgccggagcaagattaactgtaatgcgttttgccgggtatttaaattgagcattgagtaatgcactacgtactcgtccttgtgcctcagttactgttttctccggcaatccaacgagggtaaaagcaggttttccattactcaagtgaacttcaattgtcaccaaaggtgcttgtacgcccattgatgctcgactgtaaacaactgctaatgacataatttctcccaaatttttgagctaaaatataaaaaaagcagcgagtaaactgtacttactcactgcttttttgcgatccggatcgtaaaagtaaaaaagttttagctaaaaagcggagaaaaccactgatctaatttttcggataagcgttcgataccgattttattttgtgcggaaaaggcttcaacttgtacatcaccttggaaaggtaaaatcgcttctcgaaccatttttacttgcttacttctcgcactttgactcaatttatccgcttttgtgagcaataataaaaccggtaaatctgcggaaaccgcccattcaatcatctgttgatcaagatcttttagaggatgacgaatgtccattaaaataaccaaaccacctaaacattcccttttttgcagatactcacctaaagatttttgccactgaagtttcatttgttcgggaacagcggcatagccatatcccggcagatctaccagcttacaattgggttctacttgaaataaattgattaactgagtacgtcccggtgtttttgaagttcttgctaaatttttttgctgggtcaacgcattaagtgcggtagattttcctgcattagatcgtcctgcaaaagcaatctcaatcccactatcctcaggcaatacctggatattcggtgcactcattaaaaaatgggttttatgataatttaattttatgtttgtcattttattttcgcttaggtcgttgccaattggaaatatggcgttgtggaatacgagtaataaccaactcattttcttgtacatctttggtgatggttgttcctgcaccaatcgttgcaccgcttgcaattgttaatggtgcaactagctgactatcggaaccgacaaaaacgttatcgccaatcaatgtcttaaatttattggcaccgtcataattacaagtaataacaccggcaccgatattacaatgatgtccaacctcagcatcgccaatataagtgagatgatttactttagatcctttgccaatttgtgcttttttgatctcaacgaaattacccacatgagtatcttcattcaattttgcaccgggacgtaatcttgagaatggtccaattttggcattattacccacaatggcatcttcaatcacagaataaggttttatttccacattatctgcaatcgtacaatttttcagtacacaacctgccccaataaacacattattgcctaatcgtaccgttccttcgataattacatttatatcaatttccacatctttaccatgagttaattcaccacgcaaatcaaaacgtgcaggatcagcgaaagtaacacctgcaagtaacaatttttctacttgcttacgttgataatgacgttctaaattagctaattgtaaacggttatttactccctctacttccataagatctttagcttgtaccgctacaactttgaagccatcttgattggcaagttctattacatctgtcatgtaatattcaccttgtgcattattattatctaaacgagctagccatttacggaaacttgcaccgtccgataccataacgcctgtattcacttccgtaatttttagctgctcaggattagcgtctttctgttcaacaattgccgttactgtaccgttttctcgaatcactcgcccataacctgtaggattgtctaaattaacggtcaaaagtgcgataccattttccggtttttgtgaaattaaacactcaagggtttccttgctaattaaaggtacatcaccatataacatcacaatattttcgtcatcttggaaaaaaggcactgcttgttgcattgcatgccctgtacctaattgttcagcttggaatacccagtttacaggttcatcaaccaactgttgttttaacaaatcagctccatgtccataaattaaatgaatttgtgccgcacttaattttttggcagtatcaatcacatgtttaaccatcggtttacctgcaattttgtgcaatactttaggtaaatccgaatacatgcgagttcctttaccggcggcaagaataacaacgcttaatttgttcatgataaattttctctttgtcataataatcgatgtattttagcgtaaaacacatgaaaaaataatataatgttatgatgtttagcaaacatacgttcttcttttatgcaaaaaaataatcactattatattggaattatgtccggtacaagtttagacggtgttgatatagccttaatggattttaatcaaagaccgcccaaactgcttgcaagttattgtttctctatgccggaaaatttacgccaaaaacttaccgcacttttatcatccggcacaatcggtttgcagcaattaggcgagttggatcatcaactgggattactttacgcaaactcggtacaacgtttcttagcacaaaatcaaatgaccgctgatagtattcaagccatagggtgtcatggacaaacgatttggcattcaccccaaggtcaatatcctttcactatgcaaattggcgatgctaacctgattagtgtactgacaggaattacgactatcgctgattttcgtcgcaaagatatggctcatggtggacaaggtgcacctttgtcccctgcatttcatcaagccttatttgcacaacccgatcgcattacggtagtgttaaatattggcggtatcagtaatatttcttgtttaattccggaacaagaagttattggttatgataccggtgtaggtaatgctttgatggatagttggattgaacaacatttaggggtgcctttcgaccaagacggtgaatgggcaaagagcggtagtgttcaccaagatttgctaaaagatttattggacgaacctttttttcaacaacttccccctaaaagtactggacgggaattatttaatttggcgtggttgaacaaaaaactgaaaaaacataccgcactttctgcacaagatgtacaggcaacgttgctggaatttacggtacaatgcacggtgcaagagctggttaaactcgctaatccgaaccatttgccttgtttgttgttggtttgtggcggtggtgcaaaaaacagacaactaatggctcgtttacaagcctgtttaccgcaatggcacgtagcaacaactacagagcatggtttatcgattgattatgttgaagccgccgcttttgcttggttagcgtatcagcgtataaatcatttaccctctaatttaccaagtgtaaccggtgctaaaagtgcggtcagtcttggcgttatttatccgaaataatcatgaataaacaaaatttatctaatctgctcgctcaattagttaccgagcaacctaatcaacgctcagtaaatttggatcaaatgtctgcacttgaaattgtacaattgatgaataaagaagatcagcaagttccgctcgtcatagcaaaagcacttccggaaattgccatagtagtggaaaaaatcgttgctgcttttcgtcaaggcggacgcttagtgtatcttggagcggggacaagtgggcgtttaggcgttttagatgcctctgaatgtcccccaacctttggtgttaatcatgaaatggtaaaaggcattattgccggaggagaacaggctattcgttatcctgtggaaggtgctgaggataatcaacaagcggcaatagtagatctgcaagcaatccaattatgttcaaaagatattttagtgggtattgctgcgagcggtcgtacaccttatgtcatcagtggattaaaatatgctaaaaagatagggggatttaccgttgcaatagcgagtaatccgcaaagtgctatggcaaaaattgccgatattggcatcgaaactattgtcggacctgagattttaaccggttcaagtcgcctgaaatccggtacggcacaaaaattggtgctgaatatgctaaccactgcgagtatggttttacttgggaaatgttatcaaaaccttatggttgatgtacaagcaagcaatgaaaaactcgttgatcgagcgacaagaattattatgcaagcaaccggttgtgaacgagcgaaagcagagcaaacgctaacacaagcagataataatgcaaaactggctatcttaatgattttaatggatttagataagcaaagtgcggtggatttattagcgaaaaatcaagataaattacgccaaacgttagactgatttttcaccactacttttctactaaaaaggctgtcagtgcatttgagagatgagatagtttgtaaaaaataggcggagaagataaaataaagcggttcgaaactgtagattaaatctaactagttaatattgttcataaatattaatattcagtttataaacaaacattcggacatgaattgcaagctggatatgtatagtttgcaactgaaatatgatctcaaggaggttaaatgtctttattaaatatcattaaatcgtttttctcatctaaaaaggagcaagccatgccgaatattctcgtcatttcaggtcattcaaatttacagcaatccactgccaacagtgctattttaggtgaattggcaaataaccttccaaatgcagaaattcgtaaattagatgagctttatcccgatttcaatatcaatattgaagctgaacaagcggcattattaaaagccgatattatcatttggcaatttccggtgaattggtaccatttcccggcgattatgcaaaaatggttatctgatgtgttcacttatggttttgcttatggttctgagcaaaaattaactggtaaaaaattgtatatttcttgtactacggcaagtccagaagaagcctatcaacacgatggtgcacaaaaacacaccattgaagaatttagttatgcttatcagcaaactgccgcactttgtggtttagaattttgcggtattattcattctggcaatatgctttatattccgggtatgaatacagaggaagataaagaaaatgtaattgcaaaagcaaaacaacatgctgaacgtctagtaagtgcggttaaataacgcatcatgttaatagacaaaagggacataatgttttatgtcccttccttgagtcaaaataacgataacacttcatcatcatatcttttttaaaatctcaattttttctgtatttttttgaaaatctatatcgtataatgctcagtcggtttaacgataacattaaactatgtaaacattacaaacattattttttctaaataaggggtctcttatgagatacaaattatctttagtacttttatcaatgctgcccgcactttcccatgcgggggggggggggtaatttcaacttttacggcaaagcgggaattgatttaacctctcgatttgaaacgatgaaaataacggaaaatcacgatagtgatagaggttttaaattatcaattccggcaagttcaagacaaaacactttctcacctagtatcttctttgaaacgacttacaatattttaccgcaaacggaaattggtctcggactaggctatatcaaacgaaaaggctttgaccatattgcaatttggcctgtcgagggtagttctttatataacccccgaggacagtttcatctgaaagaaacctatagagtaaatcgttatgcttccctaccaatttattttattttgaaacaaaattatgccttaaatgcaaatacaaaattttatctaaagggcgatttagggtattcaattaataaaattcgtaaaacagtatatactctctatgaggatttatccttgggtagtagcacaggttataaaaaagacagagattttattagtaataataaatctagaagcggtctttacttaggtttaggtttggggattgaatataaatctttcttagtagacattggatattatcatactcattcaaaaatcacttataaagaacaaggaagttacgtatcaacaccctataacaacgatgcaatacgcttaacgcttggctttaaattctaaaaaataaaaaattaacggtcataaaataaatgttttatgaccgttaaacatattcgttaataatgtaatgctaaaaaaacatcaattattttctttaagtctaaattgttgattatggtgttgcacaaatgagtagatgaaatacaatactgtcgctgcaccgaaacagtaataaccgatccacactgccggcaacacgtcttttgccatgaaaatatacagagaaattgaaataaatgtgatgactaaagaaacagcttttgcataagcccaaggttgaatatccacttgcttagtgtattcttcgttgtatggtgtttccattggcatgatgcgaccgataattagcattactactacattcacaacaaataagatagcgattaagtggaaaaaatggatctcaactttaatcacaaatttacataggatataagctaccataccaaatactaaaccgaatttagccgcaatcgcagggacacgttttgtcagtaaaccaaccaccacaacactcaaaattggggcattaaaaataccttgtaattcttggattaagaagaataaaccatccggtgcattggcaactaatggtgcaacaatcattgccataattgctaaacctgtaccgacccatttacccacgctaactaatttcatatcgcttgcatgagggttaatttgtgttttatatacattgcgggaaaataaagttaccgatgagtttaacgcactattaaaggtggataaaactgccccaacaacaactgccgcaaagaagccgactaacgcatctggtaagactaaatgaactaaattaggataagcctgatctggaatatctaatttaccttggtaaatatgataagcaatgataccgggtaaaatgattaataaaggtcccagtagttttaaaaatgcacataaaagaacacctttttgtccctcttttaaacttttcgcacctaacgcacgctgaataatggattggtttgtacaccaaaagaataaattagaaataatcattcctgtgaataatgttgagaaaggaacaacagaattatcgtcaccaatagaattaaatttatcagggtttgtttcgtaaatggtttttaaaccatgccaagcattaccatctcccacataagctaaacctaaaacagccactaaaattccaccgaccaataacccgataccattaatagtatcagatacagcaaccgctttgagtccaccgaaaattgcatagactgatccgagtattccgattccccataccataatccaaattgccgtagtcttatcaatgttgaagacggtagagacatcaaagagactttctaatgcaagtgcacctgtataaagcacgatcggcaacaatgaaataacatagcaaccgaggaacaataaagaggtgattaataatgttcctttgtcaaaacgtttttctaaaaattccggaatagttgcaataccaagttttaaatacttaggtaaaaagtaaagtgcaaacattgcaattgtaattgccgctaaaacttcccatgccattacgataaaaccttcacgataagccaaaccgtttagacccactaaatgctcggtagaaaggttagttaataacatagatcctgcaataaacgttgctgtcaacgaccgcccggctaaatagtagccttcagagttgctaagatcgtcttttctggtgtaccaccaagcaagcacagcaacaagggctgtaaatcctataaatgagataagagatagcatagaaattccttatatgaatgagtgtttctatcattgttgtaaacaacacatcgataaggtcgaatggcgaccttgtttgaaatatatatttcaaaaattattaaatcaaatattttttttcattttgttacagagatcaaactttttagtgaaaaactatcagaaaataaccaagaaaattttatttttaagacttgtaaacccaatatgacattttggtctatatctcaagaaacaaaaatttaaattaaaaacaccgcactttttacattgcataacaccgttactaacaggtaaactagacaaggttaaactagggatgaatatgaaattactaagtaaatattttgtcagatcaatactgaacacgagcatattttgcatatacctagcaagttcgttttcttttgctgaacatcttgttgatttaaaagttgttggtgtaactggtgtacaaaaaacgactaatgtagacgcttatataaataccattgatgaagaagagcgtgatggatctgaacgttatcaacaattagttcgaaccgcaattgataaagcattacgtgcttatggttattacagtagcacagtgaatttcactttacagccggcgaaatcatctaataaacccgtgcttgttgcaaatgtggacatgggaaggccaagtattattcaacgtgccgatgttactattcttggtgaagcaaaagatgatgaggtttttcaagatttacttcgtcgtactgcccaaaaaggcgaacacgtaagccatcctgtttatgaagactataaaagccggttgcaaaagcaattactcgctcgtgggtattttgatgcaaagtttgaggtttctcgttttgaaatcaaaccatccacttatcaaggttggtggaaaatggttttaaacagtggcaccagatacaaattcggacaattcaattttaagcatagtcaaattcgtgaagattacttacgcaatatgatgccaatcaaaacaggcgataaatatttaattaatgatctctcatcacttaccaacgactatacatcatcaaattggtttagatcggttttattagaaccgaaagtcgatgaaaaacgcaaggtggttgatattaatgtattgctttatcctcgcaagaaaaatgcaatagatgtagggattgggtattcgtctgatgtaggcactcgattcaagctcagttggattaagccttggattaataatcgtggacatagtttcaattccaatttatatatatcagccccaaaacaaactcttgaggcgaattataaaattcccttactgaaaaatccgcaaagatattattatgaactgtctggtggttttgaaaaggaaaatactaaagatactcaaactatagcagcaagttttgctgcattacgctactggaatagagtgaccggttggcaacattcttttgggttacgtgtacgttatgactcatttacccaagccaatgtttcagatagaacattatttatttatccaacaatatcggcgaatagaacacgcttaagaggtgagttatttcctacttggggagactcacaacgcatcacggtagattttggaagcaaacgttggaagtctgatgtaaacttctttcgaataaaggcctcaacagtttggatcagaacgtttaaagaaaatcatcgtttcttgacacgtggcgaaataggttggttacacaccaaagatattaataaaataccgcccgcacttcgcttttttgcaggcggggagcgtagtgtgcgtggatacggttacaaaaaaatttctccaacatcttctgatggaaaaccaataggtgcaccatatctattaactgttaatactgaataccaatatcaagcacttgaagattggtggctggcagcctttgctgatacggggttggctgctaataaatttaacgttaaagaactacgttatggtgccggttttggtgtgcgttgggtatcaccggtgggagcaataaaacttgatatagctacaccgattcgagatagagagaagaataaaaatatccaattttatattggattaggttcagaattataaggtcgtaaaaatgacacaaataccaaatgaaaatacaacaacagagcgacaggaaactcgctcggttaagccaaaacgtaaggtattacgctggattttatgcacaataagtgcggtcattttattacttattttatttttagtaaccgcactggctacaaatagcggacaacgcttgttcattcagcttgctgatcatttcatagataatctgcatattgctcaaattgatggtgggttgcaagacggtttacaattaaaacaaattgcttttcacactcaaggtattaaagctgatattgaacaagcaaatataaaactggacttacattgtctattaagtggcaagatttgcttaaaagatctcactttaaatcagcctaaaattcagattgatactgctcaactgccaaagtcggaaactaaaacgtcacaaccaatacaacaaatcaagctacctgttgaagtggacatcaatggtattgagatcaaccagctggatctcacaatagaccaacagcaagttaaattagcaaaatttcggaccgcacttactttaaacaatgagcaaggtttaactttactgcccacagaaattaatggtttaacgatagttcaccgacatctcacagaaaaaacaacgaagaagaaaaagagtgaaaaaactgtaagatcctctgttgattgggaaaaacttacacaacagttaaatcaaccgttattgcctgatatgcccgaaattgagctaccttttgatctacatattcaaggtattcaaggaaaaaattggctatatcaacaaattggcaattcaaatataccgcaaagtgatttacaccaaattgaaatatcaactatttatttacacgcagacagtatagataattctattcaattacaaacgtttcaacttgaaagtaatttaggtcagctacgaggtgaggggacattgcaactcaagcaagaatttccgatagaactacaagttcaagcaacgctcaatgaacttaaacatgatggaaaattgcttttgcctcacagtaacatcaatcttacattaagtggaaatcttaaaaaacaaaccgcacttttcctgcaaactcagggaacgtttgagtcgatattacagggtaaaattgagctttattcacaaaaaacaccgtttgacattgaattaaaagtaataaacggacaatatccatttgagaaaaactctacagaaccattgaaaattcaggacatgttttttactgcaaaaggagatttgctcaattatcaagccacattacaaggcaagctcattggtatgggaatgcctgaaaccgatgtggatttagtactacaaggcggattgacacaatttaccttacaacaacttcgagttaatgcgttaaatatgaaggcgaatgcaaacgccaatgtgagctggaaagataaacttaagttgaaaagtaatgttgagctaaaaggtcataatgttcggctaaataatatgcgaattaacaaaattgatttattggctaacattagtttacaagatatagtgcaaggacaagtcgatcttgatattgatggtttcagtttaaataatattaaattgaacagcactaaattacaaattaagggaacggaacaacaacactatttaatccttaaatcaaagggcgagccggcttcagcaaccttaaatttacaagggaaatttgaccgcactttacaacaatggcaaggtattttaagtcaagtgaatattcattctttaattggcaatttgaccaatagtgaaaatattttgttgtcttatgataataaaaagacaattgcacaagtttctgcccattgctggagatcatcggatattcatctctgttttccacaagagttcattgtaggaaaaaccggagaaattccgtttgattttaaaacaattaatttagcgttagtgaataaattgatctcacaagagattttcaaaggacatttatccggtcaaggaaaattcgcatggtttacggagagttctccttatttgacgctacaacttaaaggcgataatctcaatgtggcaaaaaaattagattatcgtacttttcgtttagctatcccaactttaaatataactacagagttacaaaacaataacttaaccctaaattctaattttaatattcaaaaccgaggagacgttaatatggaattaaaattagctgatttaaccaatcagaaaaggttaagtggtcatttaaaaattagcgatatgaatttaaatatagttaatcagttaatcgctagcagtgagaaagtagatggtcaagtcaatgcaaagttgagttttgcaggtgatttaagtaatcctcttttgaatggtgaatttgctgtgagtcaagttcgagctaagttgaaatcagttccttttggtataacaaatggaaatattacactgagcttttatggtgatcgttcaattctaaaaggaaatattcaaactcacgaaagtcatttaaatgttgaaggtcaagcaaattggcgtaatatcgacgattggcaagcaggtttacatattaatgcagataaatttaaggtagatattccttccatagctaaattacaggtatcgccaaatattgaaattcatgcaacacctaaactattagcgttaagtggtaatgttgatattccatgggcaaggatcgaaattgaacgtttacctgacaatatagttgctcccagtaaggatgaagtgattttagatggtccccaaaaaactaaagtagttaaattgatgaaaggagaaattgagacaactacaaagagcggtatacaaattcactctgacttaaaaatcaagctcggcgatcatgtgcgtttagaggcatatggtctgaaaaccgaattaaatggcttgctttcagtaaaacaagaaaaaggcaaccttggcttatttggacaaattaatttacacaatggtcattatgaatcttttggacaagatcttttaattcgtaaagggattattagcttttccggtttaccttctcaacctatgttaaatatagaagcaatacgaaatccgacatcaatggaaaatacgaatatgacagtaggtgcaaaaatagttggtattgccgatagtcctgaaatcactatattttccgagccaagtacctctcaagatcaagcactctcttatcttcttaccggacgatctttagaaaatagcggaaataatggttccggtggctcacttggtgcggcattattaggaatagggttagctaagagtggaaaattagtcggtggtattggtaaagtatttggtattcaaaatttgaacttggatacttctggtgttggcgacagttcaaaagttgtcgtaagcggtaatattacccctacattacagataaaatatggtattggtttattcgatggattggctgaattgaccctacgttatcgcctattacctaaactttatttacaatccgtttccggtataaaccaagcggtcgatctactttatcaatttgaattttaacgatgaataacgaaaatttattacaaaaagtaaccgcacttgtacaacaccgcggtgaagcgaaagaaattgccgctattgatttaggctccaatagctttcatatggtgattgcccgaattattaacggctctattcaagttttatctcgtttaaaacaaaaagtacaattggcggaagggttagatgaaaataacatgttaagccaagccgctatcaccagaggcgtaaactgtcttgctctttttgccgaacgcttacaaggatttgatcctcaaaatatcaatgtagtcggtacttatacattacgaagtgcggtcaataagatagaatttttacaacaggcggcagaggttttcccctatccgattaatatcattagtggggaaactgaggcaaaaacgatttattccggtgtttctcatacccaacctgagatcggtcggaaattcgtgattgatattggcggcggttcaacggaaatgattattggcgatgattttatccctttaattgccaatagtcgcaatatgggatgtgtcagttttgccaagaaattttttccatgtggcaaaatatcaagggataactttcaacgagctaaaaaaacggcaaaacaatgtattgaagatcttgctaaaccttatcttgacttaaattgggattgtgttttaggttcttccggtaccatcaaaaccgttcatcaagttattagtaccaactataatcaacatgcaattatcacattatcgcacttaaacaagttgataacacaagtattgaaagctcaccatttcaataaattacatatcaatggactcaatgaagatcgtgtagatgtatttgttcccggtcttgctattttgaccgcactttttgaaacctttgctatcaaagaaatgcgttattcagacggagcattgcgtgaggggattatttatagcttggaaaaggatttccaagtcaaaaatattcgccaacgtaccgcacttggtattatgcaacaatttaatgtggatctcgcacaagcggagcgaacctatcaaagcaccttattgctcagtgaacaatatcaaagttggcaagctgttgaattaaaaactgaaatgcaagatattctgttatgggcggcaaggttacatgaagtgggggtcgtgattaaccataaaaatttacaaaaacattccgcttacattctacaaaatatggaattgcccggctttgataaagaacagcaacgcttacttactacaataatccatcaccaatttaatcatttcaaaatgcctgacattggaaaatttgcacgctatccgagggctgatgtaatcgcacttgttcgtttattacgtttggctattttactcaataaatctcgccaagcgacatcgaaaacaaataacattaccctaaaaaccgaccgcactctaaaaaaatggtcattatattttgatgcagaatatcttgagcataaccctttagtcaaaaatgaattgatggaagaacagaaacgcttgtcagaatttaacttagcactggacttttattcttaaaaaacgttatatagtagaacgtgcttgtttcatatcagttattgagtactacgacaagatagactaatcaagcaatgaagacgggcagttttagcatgattagcgatgtgtttaagaatgcaagaaacagtgataaaaatttaaaaataatattattttacttggagagattatgcctaaactacgttcagcgaccagtacacaaggtcgcaatatggcaggtgcacgcgctttatggcgagcaacaggaatgaaagaacatgatttcggaaaaccgattattgcggttgtcaattcatttactcaatttgtacccggacatgttcacttaaaagatatggggcaactagttgctactgaaattgaaaaatttggtggggtagcaaaagagtttaataccatcgctgtagatgatggaattgctatggggcatggaggtatgctctattctttaccgagccgagatttaattgccgatagtgttgaatacatggttaacgctcactgtgctgatgcgatggtttgtatttctaactgcgataagatcacaccaggaatgttaatggctgcattgcgtttgaatattccaacagtctttgtttcaggtggcccaatggaagcgggtaaaaccaaattatccgatcaaatcattaaattagacttagtggatgctatgattcaaggtgcaaatccgaatgtttcagatgatgtcagcgaacaaattgagcgttctgcttgtccaacttgtggctcttgttcaggtatgtttaccgccaattcaatgaattgtttaaccgaagcactgggcttgagcttaccgggaaacggctcatgtttggctactcatgccgaccgcaaacaacttttcttagcggcaggaaaacagattgttgaactgtgcaaacgttattatgaacaagatgatacatctgttttacctcgctcaattgccacaaaagaagcctttgataacgctatgagtcttgatatcgctatgggtggttcgaccaataccgttttgcatttattagctgctgcacaggaagcggaagtcaatttcactatggcggatattgatcgcctttctcgggtagtaccgtgcctgagcaaagttgcaccaaatacccagaagtatcatatggaagatgtgcatcgtgctggcggtattatggcaattttaggtgaattagatcgtgccggcttgttgaatagccaaactcgtacaattttgggtatgagcataggcgaacaaattgcaaaatatgacatcaaactcactcaagataaagccatacataaatttttccgcgcaggagcagcagggattcgcactactcaagctttctcgcaagattgtcgttgggatacggttgatgatgatcgtgaaaatggttgtattcgcagtaaagaatttgcttacagccaagatggtgggttagctatgttgtcaggcaatattgctttagatggctgtatagtcaaaactgctggagtagatgaaagcattttaaagttcagcggtaaagccattgtatttgaaagtcaagaagatgctgtatcaggcattttggggggtaaagtacaagccggacatgttgtggtgattcggtatgaaggaccaaaaggcggaccgggtatgcaagaaatgctttatccaaccagttatctcaaatctatgggcttaggtaaggcttgtgccttacttacagatggtcgtttctccggtggtacatcgggactgtctatcggacactgctcaccggaggcggcggcaggcggtttaattggtgtagtgaaagatggtgatattattgagattgatattccaaatcgtcgcatcgaattgatggtatccgaagaagaacttgctgagcgtcgagcagagcaagataaacttggctggaaaccagctaatcgccagcgagaagtttcctttgctctaaaagtttacggatatttcgcaacatctgcggacaagggtgcagtacgagataaaacgaagatataaaagttaaaagtgcggtgttttttatctaatcgtgccgtaaaaccacgtcctttagggggggatataaagcacaaatatgatatacttcttactgctaacagaggtcgctttagactctcaatgacggcataatcagggcaggacgtgcccgtagcgtctgtgaagtgaatcgcattggcggtcagcagcagaaaccctccgagagtagcccattgcttgcaatgggagctggtaggaatctccttgctttagctaggggaggacgtcaaagcagaaatggtagtgaaaatggcactttctgtaatagaaaaagttggtgatgattaataaaaataatcaaaaccaacttttgtctactgtgcttttttagatagcaggataaaatcacacctttttattagctattgaacttcaatactggcactttattttcggtgactgtttcttcttccactataactttctgtaagttttcaatagaagggagatcatacatagtatcaagcaatagggtttcaacaatagatcgcaaacctctggcacctgttttacgagctagtgcttttttcgccattgcaatcaatgcttcttgggtaaattctaattcaatattttctaagctgaataaaacttgatattgcttagttagggcattttttggctcagttaaaatttttaccaaagcctcctcatccagttcgcttaaaggtgcaataacaggtaaacgaccgataaactccggtattaagccaaatttcattaaatcatcaggttcaacttgcttaaataattcggttaaactgactttctcttcatcaatacgaacatcagcaccaaaaccaatacctttgccgccggtattcgttcttttctcaataattttatctaaaccggcaaaagcaccgccacaaataaataaaatcttagaggtgtccacacgcaacatttcttgttgaggatgctttcgtccgccttgtggaggaatagaagctaccgttccttcaactaattttagtaaagcctgctgtacaccttcgcctgatacatcacgagtaatagaaggattttcagacttacgtgtaatcttatcaatttcatcaatatagataataccttgttgagctttctctatatcataatcacaattttgtaataatttttgcaagacattttcaacatcttcaccaacatatcccgcttcagttaaagttgttgcatctgccattgcaaagggaacattgagcatacgagctaacgtttgtgccaataaagtcttgccactgcctgtcggaccgataagcaaaatattacttttgcccaattcaacctcagaagtatttttttcactgcgtaaacgtttataatgattatacaccgccacagctaatacttttttagcataatcttgacctatgacataatcatctaaatgtgcacgaatttcatgtggtgtcggtaatttaggctcttgctcttgaaattcttcatcaatttcttcgatgtcatccgcattagctaacatgtcatgacataattcaatacactcattacaaatataaccggatgtgcctgcaattaatttatctacttctttttgttccttaccacaaaaagagcaatgtaattctttttcttttgtcatttctttacccaatatctaccgtttaattaacacttcatcaactaaaccgtacaattttgcctgttctgcagacataaaattatcacgatcagtatcttgttcaatttgttcaatagattgtcctgtatgaaatgctaaacgttcatttaacgtttgcttaatttttaaaatttcttgtgcatgaatttgaatatcagaggcttgtcctctaaagccacctaaaggctgatgaatcatcactcttgcatgaggcaatgccgcccttttacctgctgtgccacccgccaataaaaatgctcccattgaacatgcttgtccaatacaaagagttctcacatcaggcttaataaattgcatagtatcataaattgccattccggcagtgactgaaccgccgggagagtttatataaatattaatgtcttttgctggatcttccgcttccaaaaagagaagttgagcaacaatcaagtttgccatacgatcttcaacttctccagtcagaaaaatcacccgctcttttaatagacgtgaataaatatcataagatcgttcgcctcttgatgtttgttctacgaccataggaatgacgctcatatatacctcttctaaaaaatctaaataacaaaagtgcggtcattcttacaaaacgaccgcacttaaaactataaaaagctataaattacgcttgagggttcattacttcatcaaacgaagacgctttctcagttacctgtgctttcgttaatacagcatcaacagcttgttgttctaacacgacattgcgaatgttattcattaactctttgtttttactataatattcaatcacttctgctggttgttcataagctgatgcaatatctgcgatcatcgctttaacacgttcttcatcagcctttaactcattagaagagatgacttcagagaataataaaccaacctgaacacggcgtttagcttgttcttcgaataattcacgtggtaattgtgcagcttgttgagcattaccgccaaaacgttgtgctgcttgattacgtaatacttcaatttcttgctcaactgcggcagtaggtacttcaattggattttgctctaacaaaccgtcaattacctgagttttaatacgagaaaccaaagcatttttcaattcacgttgcatattttttgcaatttcattgcgtaaatccgctacattttttgtattagggccaaattttgccacaaattcatctgttaattcaggtaattgcattacttctacttttttcaaagtaatcgaaaatttagcagctttcccttttagattttcagcatgatacgtttcagggaaggttacattaatttcaaattgttcacccgctttatgaccaatgataccctcttcaaaaccgggaatcatccgaccttgccccattgctaaaacaaagtctgttgattttccaccctcaaactcttcgccatcaacagagccaacgaaatcgatagtaacacgatcatcagctttagcaacatcttgagtttcaatccaagttgcttgttgtttacgtaaaatgtcaagcatcttatcaatatcggcgtctgaaatttccacaaccggtttttcaaccttgattttatccagtccttgaagctgaatctctggataaacctcaaaagtcgctgtaaattttaattctttaccagcttcaaattgttctactgtaaattctgggcgaccggctaaattcactttattttcaagcatcacattgaaaaaatgtttttgtaataaatcgcctaatacatcttggcgaacagatgcaccaaaacgtttttcaatcatttgtgccggtactttacctttacggaaaccgtcaatacgtgcattttttgctacacgtttcaattcttcacgcacagcttgctcaacagcttcagaaggaacggtgatatttacacgacgctcaagaccttgagttgtttcaatattaaatgacattatgttacctcaaaaagaatttgtactcggcggaaacacgcaccgaacacgttagtaaattaaatttacattaaaagacgaggaattatagcgatacaaaagcaaacagtcgaggaaatgacaaataaaaatctgcatttgaacattttttagcctaatagataaaatttttttgccaagaagtttttccataattttggttctcctgttgagaaatataaaatttctgatgttcgcatatcacaaaaagttatttttacgatccagatcgtaaaaaaagtgcgatggtattttccatattttctttttataacaaaattctcagtacatcattaaccgaataatataaacgcacaatatgataattcctcaatctgaagatatgtctccgatagtgatgtcgctcgatggagatacttatgaaataacaccgcacttatggcaaagaaatcagcaacaatcccaaattctgctacgctattttgccattcctttacaggaaaatgaacaaacgttatggttaggcgttgatagtctaaataatattagtgcctgtgaaacatttgcatttttgtatggaaaaattgtagaaccggttttacttaataaccaattacttaaacagttactacaaaacttatcaccacagcaaaataatatgttcgttgaagagcaacctataaatcaatatgtagccgagcatcgtatagaagtaactgaaaagtctgatgaacccgtgattcaacttttagatcacatttttgaaaatgcgttaaagcaacatgtatcagatattcatattgaaccgcaaatgaattgcttgcaaatacgtttcagaatagacggtattttacaatgccaatcgcctcttccgctttcgctgagtaagcgtattctttcacgtttaaagttactggccaaattggatataagcgaaacacggttacctcaagatggacgatttcattttaaaacaacattttctgacatccttgattttcgtttatcaacccttccgacgaatatgggtgaaaaagccgtgttgcgtttacagcaaaataaacctgtacagttgagttttgcggaactcggcatgacagaaaaccagcaaaaatcattcaaacaggcactatctcaacctcaaggactcattttagtgacaggcccaacagggagtggaaaaagtatctcactttacaccgcacttcaatggctgaatgataagcacaaacatattatgacagcggaagatccgatagaaattgaattgaacggtatcattcaatgtcaaataaatccgcagatcgggttagattttagccgactgttaagaacttttcttcgtcaagatcctgacattattatgttgggtgaaattcgggataacgaaagtgcaataatggcattaagagcagcacaaaccggacatcttgttctctcaactttacatacaaatgatgctccgtcggcagtttcacgcttgcttcaattgggtataaagcaacatgaaattgacaatagtttattattggtcatcgctcaacgcttggtacgaaaaaaatgtccacatacagaaaatgaaaattgcacttgtcatcagaaatatcaagggcgaattggtgtttatcaatttttacaaccgcatctaatggataatcatatttgctaccaaacggattatgctcatttgcgtgaaagtgcaatggaaaaagtgcggttagaaataacagatttagcagaagtggatagagttattggacaaagtagtgaataaaaaacggatcttcatgatccgcttttaacctatttaaactttttcaactttaacttgtttaatcatattatccgccacttctaatacagtaatttttagcccatttatttcacattcagttccttcattaggaatttcttctaaatgttctaaaatcaatccattaaaagtgcgggcatcttcggtatctaaattccaattaaataatttatttaaatcacgtaaattggcagatccttcaataattattgttccgtcagattgctgtgtcacttcttcatcaatagatggggcggttgaagtggtaaattcaccgacaatttcttccaaaatatcttctaacgttacgagtcctttaatatccccatattcgtctacgaccaagccaatacgttctttattgttgcggaaattaagtaattgagtatttaattctgtcccctcagggataaaataagtttcatctactgcacgaatgagcgtttctttactaaattcatttttatccagcattaggcgataagcctcacgaacccgtaatatacccagtacattttcatcaatactgcctttataaagtacaacacgcccgtgagcggcatgattcagctgacgcataatcgctttccaatcatcatcaacatcaataccggctatatcattacgtggcaccataatgtcatcgaccgtaactttctctaagtccaaaatagaaagaagcatttcttggtgtgcagaagggatatattgtcctgattgattcactattgcacgtaattcttctgagttaagagaatgtgcttttacttcattttttaaacgaaaaagtttcattagcccgctaataaatagatttataataaaaactaatggactaaaaattttcaatagtatgctaataatatgacttgaaacaaaagcaactttttcaggataaagtgcggcaatagttttaggaaaaatttctgaaaaaattaacattacaaaggtcaataaacctgtcgcaacggcaacgccaacatcaccatatatacgcatacctataatggttgcaattgctgatgcggaaatattaactaagttattgcaaattaaaattagactgaggaaaacatccgttctcttaagcaatttctctgttttttgtgcccctttatgccctttttctgctaaaaatcgcatacgatagcgattaacggaaagcactcccgtttcagaaccggaaaaataagctgagagaataagtaagataattaatgtaataaataaggtactaagggggatactatccaaaatataatcctttcattcatttccataatgccataatatttttacttatgacaatgagaccaagacattttataactctaaaataacacgactaccgaaataagcgacagtgagcaagatcatacctgaaattgtataaataatcattctttttcctcgccaatataatttccaatgtccaaataaagctataccgaaaacaaaccaagctaaaaacgaaaaaatagctttgggaatattatgagcggagaaaaaatcaattaattgaatgctaccggaaataagtgtcaaagtaagtaatatttgcccgctaaacaaagagcgaaagaaatgtttttcaacggtcattaatggaggaacaaccggcgagaaagttaattttttactttttaagctattatcaatccagcgtaattgaatggcatacaacatagcaataaaacaaacggaatatgcaaataaagataaggcaatatggaataataaacttgtattttgacttaaatgataaacccaaatttcaggtaataatgcttgtaaaattaaattgataatagaaaaacagtaaactataggcaacagaaaccaaagtgtttttactcgagccaaaatggcaacagttgcaatagcagcaatcatggcactcactaacgagcaaatttcaattaaagtgaaattattacctatgaacaaatgaataaataacttatttaacgcaagaaaatggctaataattgcgatgagtgcggtgactaaaaaagccattttattcaacttaacttcttgaccgccttgccctaataacattggcatgattaataaaatgctaattaaataaaaaaaagctgaaataaccgcaaaccacataaatttaccttacacaatatataataatggttcttattctaacttatccacttgataaaatcgctataaatttcttgcaaatgatgaaaatttaccgaatttcagtataattaaagcggtagttttttcaagaaaatataggattagaaatgtttgaaaatttatcggatcgcttgtcaaaaaccttgcgtaatattaccggaaaaggtcgtttaactgaagataatattaaagatacattgcgtgaagtcagaatggcgttattagaggctgacgttgccttacctgttgtccgtgaatttattcatcaagtcaaggaacgagcgattggcgaagaagtcaataaaagtcttacgcctggacaagaatttctcaaaattgtccaaaccgaattagaaaaagccatgggggtggcaaacgaaaaactcaatttagccactcaaccaccagctgtgattttaatggcaggtttacaaggtgcaggaaaaacaacctccgtcggtaaattggcgaaattcctaaaagagaactacaaaaagaaaataatggtagtttctgtcgacgtctatcgtccagcagcaattaaacagttggaaacattggctcaatctatcggcgttgatttttatccttccgatgtttcacaaaaacctgttgaaattgcacgtactgcattggctgaggcaaaactaaaattctatgatgtcctaattgttgatactgccggtcgtttgcatgtagatgacacaatgatggaagaaattcaacaaattcataccgcacttaatccaattgagaccctatttactgtcgatgctatgacaggtcaagatgcagcgaatacagcaaaagcatttaatgaggcattaccactgacggggatcattttaacgaaagttgacggtgatgctcgtggtggtgcggcactttctattcgtcatattaccggaaaaccaattaaattcttaggtgtcggtgaaaaaaccgaggcacttgaaccgttccatccagatcgtattgcttctcgtattttaggtatgggcgatgttctttctttgattgaagatctacaacgttcagtcgatcaagaaaaagcagaaaaaatggcacaaaaattcaagaaaggagatagctttactcttgaagattttcgtgaacaacttatcgaaatgaaaaaaatgggcgggatgatgtcgatgttggaaaaaataccaggtgcgagaaatctccctgatcatgtaaaaagtcaagttgatgataaaatgttcaataaaatggaggcaattattaattccatgaccttaaaagagcgtgctaatccggatattattaaaggttcacgccgacgccgaattgcattgggatcaggtacacaagtgcaagatgtgaataatctgttgagacagttcaatgaaatgcagcgtatgatgaaaaaaatgcgaaaaggcggtatggcgagaatgatgcgtggcatgcaaggcatgatggggggattaggtggattaggaaatatgtttagacgctaatatccacatatttatagggcgagttggatactcgcctttcttttattcagtttttgttaaatctctaatcttgcgatagaccacgtccaaattcgtactaaaatgaattttatgtatttctttcactgtcttagatttaacaatcgttcttaagggttggaactgcatattgcacatatgcaattcttgtgaaggcaacatatgttggataaaacgggtcaaagcatgaattcctccagcatcaagcacagttactgcatcacattgcaatacaatatgtttgatctctttccctgtatgagtagttttttcatgtaagtcggcaaacaagttatccgctgcggcaaaaaagagcggtccgctaatacgaaaaactacggtatcacacagatcctcaggatgagcaatttcaaaagatcttgtcatttcagcaatagtacggataaacaatagacttgctaaaagcacgccaacggtaattgcaattaccatgtcaaaaatgacagttaaagttaaacaagtcagcaagactgcaatttcattcaaacctgatcgacggattaattgaacaatttgcccaacgtttgccatattccaagcaaccacaagcaacaacgcagacatagaggcaagcggtaaataagacaatgcttttgcaaaaaataatagagagaataaaactaataaagcatgtatcacactggaaataggtgacaccgcccctgatttcacattagccgcagaacgggcaatagctgctgttgctgtaatccctcctaaaaatggtgcaacgatatttcctaacccttgagccaataattcattattagaatggtgcttagtactagtcatattatccaatatcaccgcacaaagtagagattcaattgcacctaatactgccatagaaaatgccgccggcaataaggcctgcaaggtattgaaatcccaattgatcacttctccatcagcattgggaaaattccaaggcaaaataatttcgggtatgacattcggaataccatatcccgtactatcgtctgataggctataactaaaagaagagcctattgttgccacatcaaagccaaaatgaatcaatgcaatggataataacgtaccgataataacagcgggcagatgaccgggtataggtaaacgaaacttatgccattttgtcagtaaaattagcgttacagttccaactgcagcatcagcccaattaatcgttggaagtgcggtaaaaattgcttgcaatttgccaaggtaatgtaccggcattgtggcgacattcaagccaagaaaatctttaatttgcaatgtcgcaatcacaatcccaattccacaagtaaaaccaagcgttacagagagcggaatatattcaatcaaacgacctagacgaaaaaaagccattaaaattaaaataatccctgacaatagagttgccatgagtaacccgcttaacccaaattgctgcgtcacagggtataaaatcactacaaatgccgctgtagggccggaaatattaaaacgagagccaccggacagagcaatcactatcccagcaacaatagcggtatataagccgtgctgaggcggtacaccgctggcaatagctaatgccatggacaaaggaatagcaataacaccaacagtaagtcctgcaataatgtcctttataagatgcgacttaccatagccaattttaaagctatcttgtagtgcactaaaaggacgaacggcaagaaaaatatttttagttaaaaaccactttttcaacatataaattccaacagacaagatgatagagagaagtattgtaactgaaatttaagctaataatttgttttagcacaagaaaaataaaaaatacttgactgaattagaagaaatctttatatttgccgccctaacttcaatggtgagatgtccgagtggttgaaggagcacgcctggaaagcgtgtatgtgggaaactgcatcgggggttcgaatccccctctcaccgccagagctcttcttttctctgtttttttctgtcttttttctttcattttttatcattaatccattgaaatataagaattttttgcgttttttctgtgtttttctgtgttttctctgtttttttgttatctgtgtttatgtgcctttttgttactaaatgatccctaatttgtgagcttttacttacaaaattttaattttggattttttagggatcatttgggatcttttgggcttgtttattcaattaaatcatgaggttagatgatggctaaaattaatcaatcttttgtcgataaactgaaaactacggggaaacaagagcagatttctttgggatataagctttttttggttatgtctcctaagggggctaaatcttatcgttatatttttcggcatcctgttactaaggctattaagaagaagaatttgggaaatgctgatgtgatgtctcttgagtccgctttgtctttggctatttcttttaattctttgcttgagcaaggtgtcgatcctgttgagaattttaaggcacaatttaagcctgtggagagggttgtttttactctgtctatggttgttgaggattggtatgttactaaggggatgcgtttgagcgagaaacatttacgcgataggttagcccgttttaagcgttatttgttgcctcactttggggagcgggaggttttggatatttctttgtttgaggctcgtgaggttattaaggctatttttgagcgtgcacctcatatgggggagaaggtggctcgtgatttgcgggagttgggcgatcatgctgttgatatgggggtttggagtgctaatcttttggctcctattaagcgttcttttcctcggcctaaggctgttaataatccttgtattcgggccgatgagttgccggaatttttgtgtgtgttggctcgctctcgtttggattttcagactcggcttttgattgaatttcagcttttgactatggtgcgggctaatgaggttgttactgctaggtgggttgatgtggattttgttaatgcggtttggcgtattcccgctgagaatatgaagatgaataaggcccatgatgtgccgttgagctctcaggccgttgctctgttgttggagttgcgtaagtttaatgctgataagccttttgttttccctcatcgctctattgacatcctccccggcctaaaggcaggggattcctaccagctcccacagcaagctgtgggctactctcggtgggtttctactgctgatctctattgagattcacttcatagacgcttcgggtatgtcctaccctgatatttattatgcttggactattgcttgcccacgtgtgagaacattcattgctcccactacatcggcattttctgtatagccacattctacacattcaaaatgagcttgagtttcacggttttcttttgcaatatgcccacaacaagggcaagttcgactagtattctgtgctggaacagcaactaaaaatccgccaagccattgcgttttatagtctagctgtcgtctaaattcaaaccaagattgatcccgtattgaacggtttaagcctgatttctgtttcacattttttccgtgtgcttccactgtgccttttgccgatttggacatattcgcaacttgcaaatcttcaacgtagatcatggcgtggtttttgctgatttgggttgagattttgtgcaaaaaatcttttcggcagttagckattttatggtgtaatttgccgattttttctttcagtttttgccagtttttactgaacttcactttatttttaagctgtttttgcagkttkgctaacttacctttgtaggttttaaacgcatttatcggctcaaaaaattcgccattagacagggtggcaaagcgtgcaatgcccatatcaatrccgatttctccgcctttatgyryyggratktcgtgttcaaattccgtttgaatrctcacaaaaaagcgtccgcacttttggctgacggtaacatttttcacttcgcccacaatttcacgactattgcgatarcgcacccaaccaattttcggcagrtacaagcggtcgtttycctgttcaattttgcaaccttgcggaaaacgaaaactctcttttatgccttttttcttgaatgttgggaaacttgaatgtttctgaaagaaatttttgaacgcactttcaaggtcttttaacgactgttgaagcacttgagaatggcattctttgagccaaattagctcttttttccattgcggaagtagattagcgattttgtaatagcggaatttatgattattatccagttcgtattgttcattttgccatgctaatgccttattgaacacaaaacgggaacaaccacaaaattgtttgattttgcggatttgttcaccatgcggtctaatttcaaacttaaaggctttacggagtaacattgcacaaattagaatacaaagattgttattattctacacttggtctatgaaaaaagaaacagagattagacgtggtcgccacgttgtttttaacttacacgttcatttggttttcgtgacwaaataycgcagagaagtttttactnnnnnnnnnnnnnnnnnnnnnnnnnnnatttttgaatccgtctgttcggattttgaagcaaaattagtagaatttgatggngaagacgatcacgttcatttacttgttgaatatccaccgaaagtggctatatcaaaccttgtgaacagtttaaaaggcgtttcaagcagaatgattagaaagaaaaactatccgagtattcgcaaaaaattatggggaaatcagctttggtctccgtcttattttgcaggaagttgcggtggtgcacccatatctattattcgccaatacattgagcaacaacaaacacctgattagttaggtttgaaacggctatgccgcttgtgccttatatccacgccctcaaggacgtggttttacggcactgtctgataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattttaataaaactttttcggctcacaaccgcataacatcatcatcttagcaatgatattccggtgtttttgttcctcatgaacaggcaatttaaaacgctttaaatcttccgctttaaaattcaatccttgcttatactgtaaaaaaaacttcggaaaatatttttctataatgctgaacaaataaaacgattgaatttgttcctttggggaaattactgcatatttatcttctattttgctttctttacgtaaatataggacctctcctctcgttgctgatatttgaataataattgtccctattggataaattttgtctttgcttggtctaggttctatttctgctacttctgttaaaaatcgcatttttattttcatgtaaacatcttacttaaaaagtattttttaatggtttcaagttgagaaataattttaagttcatgctcgataaagccggtgaattgttcaacttcttgctcagtaatgaatagcgagccttgcttactggatataagctgttgtatggctttcttctctttcgttcttggtgcaaaaacttgtgctaaaatttgttttacttgctcaaattcggctttatcctctgcactgccatgtgtcatttcaagttctgccaacattgcaacaaaggcttgaccgcttttttcaatatcattggttaaatccagtagctcttgtgcctccttcagtaaatcaatttcaggatcgggctctgatttatccacataacgcggaatatttaaattgaaatcattttgttgtatttctgtgtaattggctaaatgtgcgagcttatcaatattgtgccttaattgataagcggtaagcacttgattgacgtgctcaggtcgcataatgttattggatttcgctttctcaaataaatctgctgcatcgataacataaatatctgagctttgctttttaaargttaaaatagcggttggaatttttgcactgataaatagattatckggcaatcctatcacactcgakaaataaccttgctcaatcagtttttgtctgatttttccttctgagttaccacgaaataacaccccgtgaggaagaataaaatgtgccgttccctcctcttttaaatgatgtagcccatgcaaaacaaaggcataatcagctgcakttttaggtgctaagccaaaatattcaaaccgttcatcactcacgggrttccattttgcagaataaggcggattacttaccacacaatcyacttttaaccctcgccaatcyaattttgtgttttcaatatcgctatattgcccgtttctcgtcagtctatattctgcaaaagtttcaccagttaaaacatcacaatgcttaacttctgcggtgatgccacgcacacaaagattaaacaayaagaatgcaattgcctcttttgaatattcttgacaatagaaagtcgcattagggtttaccttccacttcgctattgttaacgccccggtacckgcacaaacatctaatacactatctacttcaggcgttaaccggmtcactaattggcaaatagccgatggtgtaaaatcctgttttaatgtttttctktctgcaaaattctcttgaaactcttgcagaaaacaatcttgacttaaatcaggtttttgagataaatatcgctcaaagacttcatctcgcttttgtttatcaaataacagattaataasatrctctgttatttgataatcccattttacattgagtaattcggttattttcatttggataattgataaatcaactmttcactaactccaacatttcccacgggaaagatmttttatctaatactkmtccgycttctgtttcaattgcgtrctctctgtcaayttggactattgcttktccttttktgctaaaatattsayyttgattttgtgcgattacgccataaactgcacckygccatgtgtctattttyactcttgascctacgrggaaaggyaatgtatatccgttttcggctacccattgttggatcatttcgctttcttttttktcgatagcaaaagaaaggyttttttcttcaaattcttttgcttstgcatarctccagccatrgwatttkatmaawtcttctgcyataagmtcatcgmwtycmkyccaatytcttaatagrgyttcatataagmctgtttcttcggcgggtatatsttcgcagtggtcgggatattcttcttcaatccatgctttaataaatgcakcaaaggcatcatcttcaagtgttgggcgtgggacttcggrgatccatttgttatttamtatcatgttgtttctcctgtttagtgggtttcttctaaaattggggtgattttgtaggcacggatttgtcgccccagcatttttttcgggactttgaattgatattcatagcctttttccggcgttgttgggctttgtaatatctttgcattagcgaggatttttagtgccatgttgcgtggatagccttgcgttgcttccttgaatgcttgtgggataacgtaaaaataaccgccttctcctctaaattcatcttctaggattttgatgccatagattttatttggggttttggcgttttgatctgctgggtattcaacaaaggcaccttcattcatggttatccagtccattaaattagcgatgagtttcgtttcttctcggctgttttcgccgtattcctctttccagttcaggaaattttttaatatgacttgttgattttcttcgatgctccattgggtaatatggctggcaagatgtaatgcagtttctagcacggcaaaacgatcagtagccactcgttgcacttggccgctcatgttgtcggcaagatctgcccattttttgcggatgattttataggtttcttttgcgagctctgcattttttgccagaaaggcgatccattctcgccctgcggtgccgtaatattctcttacgctttcgtttaagtggtcggcgtggcttttgttgttggtaaagtaatgtaggttttttgcctcttcgagagggatattaattaatcgcactaattgccctgcgtggacttttacgccttgcaaggcgagctgggtttcgaggtctttttcgcccgttgaaagtgcggtcactttccagcggtttatgtctttgtttcccccctcttttttgccttgtagtttgcctgtttcgttgaataggtcgtaggcgatagcttccagatttttagcatcttttgcttgtccgatttcgtccaaagtaattaagccgtcgttgcgtgctgccgcttcgttttttacgcctacggcggttgcactccagcttaatttgattttgtccgggtcgccataaagactattagcgatatttagaatagtggttttcccttttgagctttcggcgtataaatggacgccaaatgagtcacgtcctaaaatggctaataaaggtgcagcaagtgctacggcaacgcctagcatcatggatggattgccttttaggttttgtgctatttctctttgccaatcgtttaatgtgccttttgtgcggtagcctgatgcggatccgctttcgccattaaaatagataggtttactaggctctccgataatttcgccacttggcaataaataggcactatcttgccagcctgttgatgcggtgactttccagaagggagcttgtctgctgagcacatgaaaatgctctacaagatgattagtcagatttttggccgtcatcagtagccctttacgcttaagttgtcgccatcctgcttctgtgccaaagtcagcaaggcttacagcttctatatggctttctttttggctgaaatgtttccatttgaaaagatagtaataatcgccgatgtcgttgcgtccgttgcctacaagggttaatggactgcatatccaactgagcttttcattgatgacggcacctgtgtcccgatctaccttgggaacgacatagaataagccgttaagcttgccttcttctcgttcgtcaacataaggctctttgtgggtttcgatgtcgggttcatatcctacgacttgttccgcaaaggctaagtcttcgctgtccgttctgagcttttcaagatagtcgctcacatcttctaaaggttcgcccaataaatccacaaaaacaacgtcatttgctttgctgttttgtgccaggttaagcaaaagtgcggttttttttatgggggaaaattcccccgcttccattatacgcactttcttatggttttccgggataatgcgtaggcttgaaatttgttcgatttgtttcggccctaaaacaattggcttttcgggaagaaataccccgaatttgtctttaagcgtgccataatgggaaagaagatattttcctttcttgcctgcgtagctccaagcgtcctcgcctacgataataaaagcaatatctgttgtattgatggcttgctttttaaaatcctttacatttggggcgtttttgaggttctttttcttgactatcatatctcttcccttgaggttgaatagcgtcccagctgttcattttgggcgatttcacgccagcttttaaggtgcatatccaaggtataacaaaggttatccatggcgataaaatagcggtcgctttttttatgattaaactcggggctgtcggagcttgcaccgatatgttggatttcaaagagataatcaacgtaggcatttaaggttgaaattgtttctttgagctgtgcatccatggcaaaacgtacaacagaagatttagacatataaccccccttttgtattaatgcgagccacaaagacggcttgatgttgggtgagattgagctgttggcgtgcttgttggattgattttgcacgtatggcaatttttaggcggttttygcctaagaataggataaatttgaatagcattttgattgtctctttgtttagtaaatgtgaattgccgttccctaaagggtgtagcaaggcttcaactaccgctaataatcggctcgccttattcgtgcggataaactccgccttatctcgacgtatagaccttgccacaaattcagataaacagattgagcttagtaggctcaagccattgatgataggaatttgaggtaaaaaaattccgcaagtcttacgggtgcggtaaccgttattagtgatagtgtcgccaatactaaccgcactttgattttttagcaatactgaaaatttgatttttgtcatgtttctgtaccttttcaaactcatttaggctataatccatgacgttctttttagaactccatgattkattwctttcctatgagttaarttaaattacttgtgcccttgccatttggttgagggcttttttgttgggttatttccactaaactgggtgtaatcttggtgctgycccttagggttcttctatcgtttttgctatcrkctccaatcgcttactctgtatttcgtcaatatcgtcaatagaacagaataattkcgttagtactatgtctagtattttttcttgagataactgaacctcttgcccctcgtcattaaaagccattacgggctttttctcttttaactgaataattaaatctcttgaggtttctaatgtgttcttaatgccctctaaatcgggcttaaatgcgttttcttggtttgcttgataatttgtattactcatcatctaaatctcctttatagcttgaatatgcagctttaagcgtggtgatttcttttgataggttttgcatattaatcaccctcttttaacatattttcttttgcgttttgataaacgtcttttttaatttcgaaaccgtaactattacgccccagttctcttgctgctctaagcgttgagccactccccgcaacaggatcgatgacaacatcgccctcgtcggtaaaaatctcaatcagacgctttaatacatcgattggtttttgggttgggtgtaattttgggtatttcttgcggtcgtcccttgtccattccatccagtttttgatcatctttccgttattgcgaaacttcggcaatttctcgcggtaaagaattaaggcgtattctgttgcaccgacaactttcatgtttgcctttaagacttgtgggcttgaagacttaataaataccaaggggatatgctttttaaagccatacttctccgcatattcaaggaccatttggatttgttggaatgaacagaacacaatcatgcaaggcgcttgattacgctcttttggctctttaacaagcatttttgaacagaaatgcataaattccgcaatgcgaaagttttcatctgtgtcaaaaaaggctttgttggctttgtcgctttcgccgtttttattatcgccgtccttgtaccattccggactacttgcataagcgttattgcctacgttatagggaatatccgcaatgacaagctgggcttttgggatatggtagcgtttatagttttggaaatggtcgttaaaaagttcgcatttttgggtgcgtttgatgtgttccatttacgcctccttatgcattaccgcttaaagtgcggtattgttttgggttaattcgagcgtagcaaattgcattactgaggtttacgcggttgcgggcttgttgctcgttgttggcgaaaatactgaggtgtaggcggtttttgcctagtaaaatgaatttgtagatcatgagtgtaactccagttgtcattatgggagttaccgcacgcaaagtttcgaggctttgatattggcggcaacgtatcatgagctcgaaaactgcgtcaactggtacacagcaaagggcgaaacctttcccatgatacgctaccattgagattaaacactttgcaccataagcaaagggattaatttgagatgtgcgtagggtacgaataaaaaaagcacggtttaaaggcgtgctactattcgccagttgtctaacgttcgagtttcgaggctcggcacttgtttttttcaagtgcatattcatcttagtttaatccttttgcttaatcaacatgttttattatgaaatattttcatttatttgtaaaattgaatgaattactttaatataaaacaagattcataataatttccttggtatttctccttgtttgccccggttatgcactacgccggggctttttttatttgctgtttttgccatgcgattaggttttctctatcccaaatgggaatgttgcccattttttgcggtttggggattattccctgttggcaatatttgtagagcgttgaacggcttatgttgagaaattgacaaacttctctggttcgcatgtagcagctgacttgtattacgggttcttgcatagtcctccttgttggttggtttttcctgtcttttctgtttttctgttttctgttcgtggctatgttagccgtttaagtgggcttgggttggcaaatttgccaagatactttttttgattggcgttaggcttggttgtaccagttctcaagggttacatcggaggggattgccatattgagatttgctagtatatcgccatgttgatttcttaggcgttcgaggtcttgcccgagcttgccattgcgtagggcgttgcgggcttgttgtggggttttaatatcgtaatggagatataatagggttttgatgaaattaatttgatgttgtgcaatacgggggcttggcggtttgccatttgcccctgcgatgcggttagttctgttttttttgttgatatagctcaatgagcattttaagcacttcgggacggcttttgccttgttctttggcgattacatcgaattggtccgccagttcgctattgatgagcatgctaatttggcgtactttgccttcagcttttaggcgttgattgcgttcttttgcggtttgtgctctgagctttttactatgttctgtgtttgaatttgccatggttttctccttgatttttttaagtgggttgtttaagattggagccatcgggggaaactctgacctttccccctttggattgtctaaattagtaagctggagaactcactaccaacaacgctaataagattatgatgattgctaggaatttcatcattcttacttcgtttaatgccccgtaactgaacaagtcggggcgttcttgtttctagcccttgctagatgttttatattgtatatgcttatataataaaagcgagtattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttatttgttggcttatttgttctatctcttctatcacttctagcgggagtttaaaggctttaagtttaatccctcgctttgcatcagattttgcaactcgttcagcgtttgtggttgccctgtttttctcctgtctttgcttgatttttaaaagttgaagttgtatagtttaggaactgcctagcggtggcacccgctaggtcttacgtcatcctaataagccgattggcttattactaataggatgattagaatgatgattaaccgtggattcatcttctatttcctaagttgccccggtttctccaagccggggtttcttgtttctagccccttgctagatgggtttatattatataggcttatataataaaagcaagtatttcttgaaaaaataccgcactttttgggtgcggtttttttctatttgttagcttgtttaaaacattctagtgcttggataataagttggttttgcggtatgcccagttgttggcttatttgttctatctcttctatcacttctagcgggagtttaaaggctttaagtttaatccctcgctttgcatcagattttgcaactcgttcagcgtttgtggttgccatgtttttctccttgatttttttaagtgggttgtttaagattggagctgttagggaggatgcaccctccctaacatttgttatcttaattagtaagcgttatggcttatgcttattaagacaactaggatgatgattttgattagcatatcctagctccatttaatgccccgtaactgaacaagtcggggcgttcttgtttctagccccttgctagatgtccttattatattagataactaatattgatacaagtatttcttgaaaaaacaccgcacttttggggtgcggtttttttctatttgttggcttgtttaaaacattctagtgcttggataataagttggttttgtggtatgcccagttgttggcttaagttttcaatttcttttactactgttttgggtagcttatagcttttcgcttgcatgccgttttttttcatcacttttagcaacaatttcagttcttgacaatttcatctttaactcctattattttgaagtaccggggagccgttactccccgatttatcgtaactattaataagccgggaaacttagtaatagtagaactacgataaggaaaattttcatcaacatagtattttcctacttcaatcgttcagtatactgatttatacgagtcttttttaaaaaaataccgcacttttggggtgcggtttttttgttatttgttgctctctctatacatttcacaaagttttttaattgtttgcggtcttgatagacctagctcttgtgcaatagcatctaattcgtttgcatcttcggtggcaaattgcattgtgatacgtttgacaataccagcctctaggcgttttttattccattcattcgctgtttttattcttaatttgcgtgaatgttctgtttttgcgtatgccattgttttctccttgcttgattttgttagtcggtggttgtatattaggaactgcctagcggtggcacccgctaggtcttacgttatccttagtaagccggcacgcttaccaacatcaggataataaggattaatactttaaccaacataatccagttcctattttagttgagcggtgaaagtcgctcttcttatttccgccctattgcgaaaacgtgattagtatattacaataatatactaattacaagcattatcttttttatttcatttgtttttcttctcttttttcttcttctcttttttcttcttctcttttttctcttcaattcctaaaaaataggaacaaaattcctaaaaaataggaacaaaataggaaaaaataggaacactcaattttattaacttattgatttttaatgtattcattaaaaaaattcctatttttcctatttttcctaatttaatttcatgtataaatgtttttataataaaaaagcacccctaagggtgcttatttatttacatccacataatggaatgggcattggtcgatgttttgctctgataattgctccagtttttggatcttcacgagtccatctgaaaataatagggcaaacacagccacatttagaacaaatagttgtagccataagactaatctccatttgataagttgccatcacttatctatggacaataccgcacaatctgttttagaatagactaccgtttcttctatgttgtaggtattgtgtacagcggatggagaactgcacatagtaattaatacgccaatattaattacttccagtaaagacccagccatttcagttgggttttttacattccgccaaaatcaagttctaattgcggtgatgtgtaaaatcctaatcgttctaaaactatttctgcaaatgtatcagcttgccattcagcatcttcattctttgtcggtggaacctttgcattatgcaataccgccctatgacctaaaaacaaatgaccaaattcatgaaatataatgaataaagatgttctatcacctctacaagctaactcataaatactttcaggaatagttattgtaaaagtacttggatcaaaatgacctcgcgttaaattccctgttgtttccttccattcttcatctgattttatagacaaattgataataaaattacttctctcctcaatttgctgaaaaaccttctcgcatttcttgcgtgatttttttgtaagtccgaattcgtggcaaaagttcaaggcggtggatataacttcaacttcttgcataggtgggaccctatttcctcgtaattgatatgaactcatttactatccttttcatgattaatacgagttaataattcagaaatttgagctagttctttagcggtataacgtgaattagcgaatccagccactagcatcttgtgatgttcagataaaccatctatcggaacattttcattagaaacatcggctaatttttgtaattctttcacctcgatgcctttctctttaaaaaaatgagttatcgcaacgacccattttttagatatttttttacttcctgtttctaatccgcttaaataagccggtgtagttcctaatgcttttgacattgtgagtaaggtttcattagcatcaattctagccttacgaactattttgccaaattctgtaagagccataatatattctcctagtgtgtagccatgtttgtatcttatttaaaagataccttaaaaagtaataaaattcaacttttttagttaaatttaaattttatttcctgtgccgttcctatttttaggataaaaataggaacaaaattcctaaaaaataggaacaaaataggaaaaaataggaaaaaataggaacactcaattttattaaatgattgatttttaaaatattcattaaaaaaattcctatttttcctatttttcctaatttaatttcatatataaatatttttataaatcatgagataagttaacttgttttttgtaatgaaaacattacaatagatatattcataaggagaacttaatgtactcaataaaacagacatcaatttttaagcaatggttgaagaatataaaagatcctattgctaggattatggtgattaagcggattgaaagagcaaaaaatgggaactttggcgatcataagctattggcaaataccggcggaatttatgaaatgcggatagataccggcaaggggtatagaatttattacgcaaaaattggggatattatctatttgctaacaaacggtggagataaaaaaactcagcaacaggatataagcgatgcccaagtgatattagaaaaatttaaacaattaggagatgatgaaaatgagtgaacaaaacaatatagaagtgactgattttgatgctgcagaatttttagaaaacgatgaattgatcgctttatatcttgcggagacattaaagaatggcaatgatgaagaatttattcaagcactcaatactgtggctagagcaaaaggcatgaatgatattgcgaaaaaagcggggattgctcgtgaaagcctttatcaaactctttcaagcaataagccgagatttgaaactgtgcgtaaaatcttaaatgctttaaatattgatctcattcctacggtaaaaacggcttaaatgccgtttttttctgtgccattcctattttttaggataaaaataggaacaaaattcctaaaaaataggaacaaaataggaaaaaataggaacagtcaattttattaaatgattgatttttaacatattcattttaaaaattcctatttttcctatttttcctaatttaatttcatatataaatatttttataaataaaatttgtattattgccgttttctatgaaaatttttcacttttttattctgcttatctgatcaaatatttacccataacaaaaaagcagaataccaaatgatccctaaaagatagttttaaaaacaagaacccttattgtataaggcttgaaccctcgaagcagatgaaccctctcaccgccatctaactgtaaaataaagtttgtcttgtaaaaaacaattaaaaaatcaataagttaccattccttaattgttcacattgtaaaataatgtttgtcattgtaatcgcttgatgttcccttttatgttccttttttgagagctaaaaaagtaacagcaacgttatttttatgtagagctaaaatctatgtaaacgtttgcttaatgaaagcgggctgcggtaaaataacccgattttatttaaagctaataaggtattcatatgacacagctaagtttgaaaaaaatttattcggggaaagtacgggatctctatgaaattgatgataaacgcatgttaatggttgcaacggatcgtttgtcggcattcgatgtaattttagatgatcctattgatcgtaaaggtgaaattttgacgcagatttctaatttttggtttaagaaattagcccatattatgccaaatcattttaccggtgaaacagtttacgatgttttacctcaagccgaggcagatttggttaaagatcgtgctgttgtttgcaaacgccttactcccatcaaaattgagagtatcgtacgaggctatttaacgggatcgggattgaaagattataaagccactggcacaatctgcggattaaaattgccggaaggtttggttgaggcaagtaaattacctgagccgatttttacaccttcaagtaaagcaaaagtaggtgatcatgatataaacattagctatgcggaatgtgagcaattaattggcgttgagcttgcaaagcaagtacgggaaaaagcaatttcactttataaagaggcagcggaatatgcactgactaaaggtatcattatttgtgatacgaagtttgaatttggtttagatgaaaatggtgtattaaccttaatggacgaagttttaacgccggattcaagtcgtttctggtctgtggaaacttatcaagaaggcactaatccgccgtctttcgacaaacaattcgtgcgtgattggctggaaaagagtggttggaataaacaggctccagcacctaaagtccccgctgatgttatccaaaaaactgttgataaatataaagaggtattggatttattaacaaaataattggaagtgcggtgaaaatttgttaaatttgaccgcacttttgccatgaaataagtttgagataatatgagagctgtttcaatcgtagggttagggtggttaggtttaacacttgcccgtcatttaaaaaatctgggttggaaagttaaaggcaccaaacgcacacatgaaggcgtggagcaaatgcgtttaattcgattggaagcctatcatctggaactcacacccgatattaatgctgatcccgatgatctaactgcattactttctgtggatgctttagttatcaatattccaccgagtcaatatttttttcatttacaacactacgtacagggcgttaaaaacttagtgaatgaggcattgttaaacggtcttcaacatattatttttatcagctcaacctctgtatttcctgatgtttcaggcgaatttgatgaacaaagtcagattgtaccccagtcagaaatgagtaaagcattgcttgaaattgagcaatggctgtttgagctgaaagatgttgactgcgatattattcgttttgggggacttgtgggcgaggatcgtcatcccgtttattctttagcgggaaaagatgaattatcagcagggaatatgccgatcaatttggtgcatgttgatgattgtgcaagagctattcaattgttattggaaacaccaagttcccagcgtttatatcatttggtcgcaccgcaacatccgactcgagcagaatattactcacagatagcagaaaaattatcactggaagcaccgcactttatttgttcggaacaagatccaagacgtgttattttagcgaataaaatttgccgagagctcagttttgtttatcagtgtccagatccttatttgatgttatttgaaagaaaataaaaaatatccgatttgcatttttaatcaaaaaaatgcaataatatgcagaatttattcaaaaaaaaatctataattcaaaaaagaaggtcataaatgtcaaatacaattttacaacatcttccaatcggtcaaaaagtaggtattgctttttccggtggtttggataccagtgccgcattactttggatgcgtcaaaaaggtgcagtaccttatgcttataccgctaatttaggtcaacctgacgaagaagattataatgctattcctcgtaaagcgatggaatatggtgcagaaaaagctcgtttaattgattgccgcaatcagcttgctcatgaaggtattgccgctattcaatgcggagcctttcatatttccacaggcggtgtaacgtattttaatactacgcctttaggtcgtgcggtaacaggtaccatgcttgtttcagctatgaaagaagatgatgttaatatttggggcgatggttccactttcaaaggcaatgatattgagcgtttttatcgctacgggttattaactaatccgagtttacgtatttataaaccttggttggataatcaatttattgatgagctgggtggccgtcaagaaatgtccgagtttttaatcgcaaacgggtttgattacaaaatgtctgttgaaaaagcttactcgacggattccaatatgttaggtgctactcatgaagcaaaagatttagaatatctcaatagcggtattcgtattgttaagcctattatgggtgttgccttttggcgtgatgatgtaactgtgaaagcggaagaagtgacggtcggatttgaagacggtgttcctgtcacattaaacggtcagtctttttcaagtgcggtcgaactctttttagaagccaatcgcatcggcggtcgtcatggtctgggaatgtccgatcaaattgaaaatcgtatcattgaagcgaaaagtcgtggcatctacgaagctccgggtatggcgttattgcatatcgcctatgagcgtttggttacggcgatccataatgaagatactattgaacaatatcgtatcaatgggttgcgtttagggcgtttattataccaaggacgttggtttgatccgcaagcattgatgttacgtgaaacagctcaacgttgggtagcccgtgcggtaaccggtgaagttacattagaattacgccgtggtaacgattattctattttaaatacagtgtcaccgaatatgacttatcatcctgaacgtttaagtatggaaaaagtggaaaatgcaccgtttgatccgtccgatcgtataggtcaacttaccatgcgtaatcttgatattacggatacacgtgataaattgggtatttatacacataccggattactgactgtaggtaaagattcaatgttaccgcaattggataaaaaatagtttttttacacgccgacatagttgaccgcacttttaagtgcggttagtttttgctacaattctccgttttaaaacaagcaggttatacaaacgacggattcatctgataatgaaaaatttattttcttttccttctttctatcagttttctaatgaaagacgttttttaaaacggttaagaactcgtattcgctattatttttatcgtttaacttgttttaaagaatgtcagatttttgttacctatttaaatcataatcctctttggattgatatattcacgaaaagttacaatcgttgtgatgctgtgcttagaaagtattgcgataaccgttttaataaaaaacaacgtgtacaagcaattatggataatttttccgtagcagaacaagtatttgggcggtctttctcacaactgttagttgaaaaagataaggttttattggctgaattaacagatgagttggatttgtatttagcaattaatcaaatagatccttttgagggtttttttgcggtaaatattcgcaataaacagggtcaacgtatttacgatgcctctttttcttttttggcagggaataaattattgatcacgtctgtgcaaggacctagtgatgataattcacaagaattaattaaatcgacaacgaagcaattacatggtgtacgcccaatgtttatgttggtaaatgtgtataaattgttagcaaaagagctgaattatgaacttttaggcatagcacataaaaatcaaggaaaatatcgttggaacgacaatgcacgtttgttatttaattatgatgatttttggcaagaaaataatgcacttttaaaccctcagggctattggcaattacctgtagttattgaacgtaagacgctggaagatattcaaagtaaaaagcgttccatgtatcgcaagcgttatgaaatgtttgattttattgaaaaaaatataactgagatttttggaaaagaaaatttgaataaatagaccgctctatttggtattcaagttttaaatggcatataatgagttgctattgatttttagtttgttttattaatttaaaggtatgactgtgacaactgaacgtattgcaagaataattgaatcaaaagaaattatgacacttctccctcatcgctatccgtttttattggtagatcgtgtaactgattatgaagaagggaaatggttaaccgcaattaaaaatgtgagtgtaaatgaaccttgttttacaggtcatttccctgaccaacctattttgccgggggtattaattttagaagcattagcacaagcaatggggattttggcgttcaaaactcacgagttaagtaataaagagctattttattttgccggtgtggatgaggcacgttttaaacgtcctattttaccgggagatcaaatgatgttaaaagttgaagtcattagggaacgccgtggtattaccgcttttacaggtgtggcgagtgtaaatggtgaagtagcttgtgaagccaaattaatgtgtgctcgtagataattaaggagcaaaaatgattcattcgactgcaaaaatccatccttcttctattgtcgaagaaggtgcaaaaattggtgaaaatgttgttattggtcctttttgtattgtgggaagcgatgtacaaattggtaaaggtaccacgttacattcccatgttgtcgtgaagggagtaactaccataggggaagataaccaaattttccaatttgccagcattggtgaagtcaatcaagatcttaaatatcaaggtgaaccaacgaaaacgattattggtcatcgtaatcgtattcgtgaaagtgtgactattcatcgtgggacagtgcaaggtggtggtgtaactcgtattggtgatgacaacttgttgatgattaatgctcatattgcacatgattgtcaaattggaaatcgttgtattttagccaataatgcgacgttagcaggacatgttgaattaggtgattttgttattgttggcggtatgtcagccattcatcaatttgttattgttggtgcacatgtaatgctaggtggtggttctatggtaagtcaagatgtgccgccttatgtaatggcacaaggcaatcatgcacggcctttcggagtaaatatagaggggctaaaacgtcgtggttttgataagccgacactacatgcaattcgtaatgtgtataaactgatttatcgcagtggcaaaacccttgaggaagtcattcctgaaattgaaaactatgcacaaactgaaagtgcggtaagttttttccttgactttttcaatcgatcaacacgtggcatcattcgttaatgggtagcctaaaataatgttgtaataaaataggaatgaaccgcactttttttaagtgcggttattttttatggtgtttttatgatagataaaaaaaatataacaattggcattgtcgcaggcgaagtatccggtgatattctcggtgcaggtcttattcgagcgttaaaaatacaatatccacaggcacgttttattgggattgccggtaaaaacatgttggctgaggggtgtaaaacgttagttgatatggaagaaattgctgtcatggggttggtagaagtaatcaagtatttgcctcgtttgctgaaaattcgtcgtttagtcattgataccatgttagcagaaaagcctgatatttttattggcattgatgcaccggattttaatttggatatagagttaaaactcaaaaagcaaggcattaagacgcttcattatgtcagcccttctgtttgggcttggcgacaaaagcgtattttcaaaattgctcaggcaacgaatttagttcttgcttttttaccctttgaaaaagcattttatgatcgttttaatgtgccttgtcgctttgttgggcataccatggcagatgccattgatttgcaaccggatcgccaagatgcttgcttccaacttaatctggagccaaaacatcgttatgtggctattttagttggaagtcgagaggcagaggttcaatttttaactcccccttttttacaaacggcacaattaatcaagcagcgttttcccgatgttcaatttttagtgcctttggtaaatgaaaaaagacgtaaacagtttgaacaaattaaagcccaaattgcaccgcatttagaggtcatttttctagatgggcaggcacgccaaacgatgattgttgctgaggctagtttacttgcctctggtacagcgtctttagaatgtatgctatgtaaatcgccaatggtagtgggttataaaatgaaaccttttacttactttcttgcaaaacgtttagtgaaaacgaaatatatttcgttaccgaatttattagcagatgacatgttagtgcctgaaatgattcaagaggattgtactgctgagaaattagctgaaaaattatctgtttatttggagcaaacggaaagtgggattaaaaatcgccaacatttaattcaacaatttactcaattacatcaactgattcgatgcgatgctgataagcaggcggcacaagcagttattgatttattaaatgatgaggtataaatgacaaatgtatttatttatccgaatgtggaattcattgcaggcgttgatgaggttggtcgaggacctttagtgggtgccgtagtgacggcggcggttattttagatccgcataatccaattgaagggctaaaagacagtaaaaaattatcggaaaaaaagcgtttgcttttggctgaagaaattaaacaaaaagcgttagcttggagtttgggacgggcagaaccggcagagattgataagttaaatatcttgcatgccactatgttagcaatgcaaagagcggtagaaaatttgaaaattcaaccgcactttgtattggttgacggtaaccgtattcctcaattgccgatgtcggcacaagcggtgataaaaggcgatagtttggttgctgagataagtgcagcatcaattttagcaaaagttgctcgagaccaagagatgatagaactggatagacgttatcctgagtacgcttttgcacaacataaaggttatccaacaaaattacatttggaaagattagctcaattcggggtattacctgaatatcgtcgtagttttgcaccggtgaaaaaattgttatcaactttattgtcaaaaaatcacgagtacattttcaaaatacaaaaataaatattatgttagaacctgttattgagtataatgagaactcagttttcaaaaggaaataatatggctacgcttttaaaaattggcttagtttcagtctctgatcgagcatcacaaggtgtctatcaagatcaaggtattcctgaactgcttgaatggttaaaatctgctttatgcgatccgttcgaagtggaaagtcgcctaatccccgatgaacaaaccttaattgaaaaaacactttgtgaattagtggatgattgccattgtcatttggttttaactacaggcggtaccggtcctgtaaaacgagatgtaacacctgatgcaactttggctgttgccgatcgtgaaatgccaggattcggtgagcaaatgcgtcaagtgagtttgcattttgtgcctactgcgattttatctcgtcaggttggtgttattcgtagaaatagccttattttaaatttacccgggcaacccaaagcaattaaagaaacgctcgaaggtgttaaagatgaacatggtaacgtcattgtgaaggggattttcagtgcagtaccttattgtttgcaactgattgatgggatttatattgatacagatcccaatgtaattgaaagttttagaccgaagtcggcaagacgtactttatagttgaaaagtgcggtagcttttttattttgtttgaggaagatgatgaaaaaaattgaagcaattattaaaccttttaaattagatgatgtacgtgaaagtttagctgatatcggtattaccggaatgacggtaacggaagtgcgtggttttggtcgtcagaagggacatacagagttataccgtggtgccgaatacatggtagactttttaccaaaagtcaaaatggagattattgtgcctgatgaaattgtcgaacaatgtattgaggcaatcattgaaaccgcacaaaccggtaaaattggtgacggcaaaatttttgtgtatgatgtaaatcgtgtcattcgtattcgtacgagagaggaaaatgaggaagcactttgatgtctgaaagaaattcatcgctaactcaagtgctggttgcttgtgctgcaattatcgttattttaggtggcattaaactcgccagtgagattgttgtgccatttctattatcgttatttattgcgattatttgctcacctgtggtgaattttatgactaaacggaaaatacctcattggcttgcgattactttgctttttgtattaattgtggtgttattttattttttagccagtttaattagtaatactgttcaggagtttactcaatctattcctcaatacaaggtactgttgtcacaacgtttaaatgatttgttagcttttgctcatcattttaatattcctttatttttttctaccgatagtattaatgatgattttgatcctagcattatcatgaaatttgtcagtcgttttttgttgagcttctcgaatgtggtaacaaatatttttgtgttgtttttgatagttgtctttatgcttgctgaagcacctactgtaaagcaaaaatttactaaattaatcgttactgaaaatactgttactcaacaaaattatattgaacgtattctacaaggcgttatcggctatttaggcgtaaaaacgattactagtgtgatgacaggattgtgcatttactttgttttatccgtccttgatattcaatatgctattttatgggctaccttggtcttcttattgaattatattcctaatataggatctatcattgcggcagtccctgttattgtgcaaagttttttattaaatggatttatcacgggtttagttgtcagtattgcatttattttgattaatactgtggttggtaacgttttagaacctaagatgatgggcagaaaattgggactatcaactttaattgtttttctgtcacttttattttggggttggttattaggaacagtaggaatgttgctttcagttcctctaacaatgggattaaaaattgcattagaggcaagtccaaatacaatcaaatatgctgagttattaggtgatgtaagcgatgtgcaaaatgttaaatgacgaaaatttattttttaccagactgtgccgtaaaaccccgtcctttagggcgtggatataaggcacaaatatgatatacttcttactgctaacagaggtcgctttagactctcaatgacggcataatcagggcaggacgtgcccgtagcgtctgtgaagtgaatcgcattggcggtcagcagcagaaaccctccgagagtagcccattgcttgcaatgggagctggtaggaatctccttgctttagctaggggaggacgtcaattgacgcaatatatctacaaaaggcatctttcttttcagatgccttttatcttataaaaacttctctttgtactttactaagtcttttttatgtagtgcaaagacgcctattccgccatttcttaattctaaccattggaaaggcacctctgggaattgttcgattaaatgaaccatactattgccaacttcacaaattagtattccattatcagtaagatagtcagcagaatttgccaaaatttctttagtaatagtcagtccgtcaattccggagcctaaagccatttccggctcatgatgaaattctataggcatatcctgcaaatcttcttcatccacataaggtgggtttgtgataatcaaatcatattgatcgagcggtaaatttttgaataaatctgactgaatagggaatacacgatgggtgaggttatgacgttcgatattgatttcagcaacatttaatgcgtcaatagataaatcaaccgcatcaacttctgcatgggtaaattgttctgcacaagcaatagcaatacagccacttccagtacaaagatctaaaattctgattgggtcttgttggagtaaccctttgaatttattcgtgattaaagcactgattggtgaacgaggaataataacacgttcatctacataaaattctaatccacagaaccatgcactattagttaaataggcgataggtaaacgttgctcaattctagcaataactaattgaatgagtgaatttttctctgaagtcgtgagtgctgaattataaagtttttcgggaaaatctagggggaggtgtaatccggttaaaatgagctgaagactttcatcccaagcattatcataaccatgcccataataaatatctgaacggttaaaaatgctataggtccatctgagaaaatcttgtattgtatgtaggctgttctgaacctgatctgttaaaatgcaatctacaagttcttggttaaactgatttatggtactcatattaattctctcaatcaaataaacggcgtagttataccatagttattcataatgagtaagttaaatttaaaaatagggaaaagtatgttaaatgatgaagatatagaattatttcatcgtgaaattcaaggagcaaaaaagatagaacagaatatttttattgcaccacgtcatcgaaatttaaaaaataaagtggagattcgcaatgttcgagaaaaagaagataccttatttttcttttcagatgaatatgaacctttattagatgaagaaagtgcggtgaaatatttacgtccacatgaagatcgttatttgttaaagcaattacgccgtggtgatttctcgcctgaactttttttggatttacatggtttgacacgtaaagaggcaaaaattgagctggcaagccttattcatgcctgtgaaaaggaacatgtttattgtgcttgcattatgacgggatatggaacttatacattaaaacaacaaatacctcgttggctagtgcaacatccaagagtaagagcgttacatcaggcacccagagaatggggaggcgacgctgcaattttggtattgttggacgtttagattatttgttagcatcaagtttagatgtacgttgattttgccggaaaaccgtataaagtgcgggtaatatttggttaatcagattaagttgttgcaatggaattgcgacttcatttcgattgaactgatcagcatgttcatcactaaattgttttaaagaaaactcaatatttagcaataatttttcaaaattatctcgttctaaagtttcaatatgctcaaggacatgaagtaattttttggcgataggataaaactcccctaaaaacaccgcactttgctgaattttctgcatattttttctatatgcacctaaagcagaaatataactcagtagcgaatagttaattttgaccagttcaaatccttcttgcaaataggcttgatattttttaggttcgctattcatgtttgatagggttgtacttaatgcggttgcatattcatgtgcttgccgtctggcaatacgatattttagcggatcacctttgccgaataatagttggctaatgatatataaaaagtatttagcattagcttttatcgcttgttttatcactttatttagttgtagatatttccaatccggccataaataagaaacagcactccaagcaataaagctacctattaatgtgtcggttaagcgagataatagagcgttatttaaatcaaatcccatgatattaaagctaattaagacttgtagtgtaataaaaaaagtagagtagctataattattgctacggaaaaagaaaaacaatgtactagtgacgacaactaaacctaattgcaattctaaagttggatgtatgtaaggcaatagagaaccgattaccacgccaagaattgtaccaatgatacgttgttttaatcttaacttagtcgccgaataattaggttggcatacgaaaacagcagtaagtaagatccaataacctaattgcaaattaaatatttctactaaactacagctaacaaaaacaatgatagatagacgtattgcatggcgaaaaagttgtgattcaaaggtaaaatgactacaaattgtacgccacatattttttaaaccaatgatctgctctgtatatatttgcgttccttcagatcgttcatttgtattttccgaatattgatccatatggtgtaattgccaattaactgcctgtaaattatcgattaatgttttaatggcaagtcgttgtaattgatttaagtgactgttttgataatgtatttcaaacgactgattaatacctaaaatcgcttgttccaaacgaggattgtacgaataggatttattgtattgcagactatgagcaatttcacgacaagattgtgcttgtagctctaataagcgttggatacgaaaaataagatccgtattttttaattgctctgataattgttgataattaaaatgacttgaattaattcgttcatgaatatcttgtgcagcaaaataatatttaatcatttttgtcgtacggcgatgtttatgttgtccacgaatgcgatgaaataatgctgtacgacaagcgttaaaggcagtaattaaattaccgtttttcatggcaagaatgacacgtttattttctaattgttcaatatcatcaggatcaaaaaaaagtgattttgtgtctaaatattctgataaagcaagaaaagcttttgtcatattttcttgtacagggcgatttggaaacattaaatgaacaaaaaccgtgcataaactataaagtaatgtgccacataaaattaaaatagggttgatataccaagaaacatttggtgtataagttaatgttgtataaagagctacaacgagtgtaccgaaagcaatagtgctataactttgccctatagcaccaaccatggtaaataaaaaggtaagagcggtcattaataacaaatattcaattccatgccctaaggtgagttgtacactaagagaggaaatagaaaaagcaattaatgtataaaatacatatttaagtcgtcctgttaatctattatccaaatcaactagtccgcctgcaataatacctaaaattaatggcatagactgttcggaaatatttagtttccaaatagagaatgtcactatatttactgctaaaaaaacaggaatggagagaatgatttttgtattaatccaaggggtcattttatattttttctaaactttttattattttaaccgctcttttaagtaaccttgatagtctagaatacgaatttcagtttcttgttggaatgcaggagaactaattaaaaaatcagcagtagcaatattcatcgcaacaggaatgttccaaacagttgcaatacgcattaaggctttgacatcaggatcatgaggaaccgcattcattggatcccaaaagaatatcagcaagtcaattttcccttctgcaattaagccacccaactgttgatctcctcccataggaccgctaagtaaatttttgatttctaaattcgtttcttgatgaattaaatttccagttgtccccgttgcataaagaacatgaggttgaagtaaagtgcggttagtttgacaccattgtatcaaatcttgtttgcagtgatcgtgtgcaaccagagcaatttttttgttttttgtcaatttgcgataggtggtttgcataatgatagtccttaataaaaaagtgagcttaggcccacttttgagttaaaaaccggttataaaattatttttggttttttgcccaattgaggaagcgaacttgagtttctttgtcggcttgttggaaccaaaactgtaattgttgctccgcaatattttcaccttgcacgacgacttttcctttttgtgctttagcaaatccgagagcaacagcaggcattgccgttgcaaagttggaaactgaagcaacagaaccggatgcattatattcagataatgtatcaattaggttagcccctggaaggaaaccttcttgcttcagtatttcttgttttgtcgcaattatttttccgctatttgttttgacgatgacagacggtgaatctttaaaatttttaatatctcgttcattttccagtttaggggctgagataactacgtcttcgtttgtgccttgaaatgtaacaacaataggatctgattcatataaagaacgatctgagccatgacgaacaatttctgaaacacgaacgacgacttggtgagtttgcgattcattgatattaaatgatttagtagattttaatagatctttattagctttttgtccatcaatagctaagaaatctatgtttgatgaactggttactataccggcaaaagctgctgtacttgttaatagcattgcacttgcaagtgctgcaaaagaaaatttcataattgctcctatagcctcaggaaatataatataaacttatccgcttttagaaaaagctaaccctgtatgctattccaaattaaataaaatgggaatagaaaaaactcgattatttgatttttttctatttttgtagtgaataagtaaaaaaagaaagcaaatttacttcttagttttttttcatttagtatattcaagaagaaattttgacgctgtggaaaaccgaatcataaatgttcgaatcacgatagactgccattctcaaataaaccaactatatagtccctgattgatcaacccgctttactttttattcattttcgaatagactgcctgaaggtgcaatttctcattgattcgtacgatttcttcatttctgtagggctacatatgaaaaaaatgtcggtattaatttggccttgcggtttttcatcattattgtcggcggtagaacgaccgatcctccaattaaatcgtattgatgcccaacagcaacaacgccaaaaggaacaaattcaacagcaaagtgaacgacttcgttccgatcccgatgtgagaatggaaatttcttcagaaaaacctaccgcacttccctttaatgaatctccttgctatcccattcaacatctttccattgtagattattcctccgataacaagacaaaacctagccaatttcaatgggcactgaataaagccgtcacgcaattaaacctccaattaccgcattgtttcggaactcaaggactagggattttgatgaaacaggtgcaaaataatgtgattgaacgaggctatatcacaactagagtggttgccggcgaacaaaatttaacgcaaggcgtattttctttaacggttattcccggtcaagttcgccatacgattattgccgatgtaagtagcctcccttggtttagtaaactgacagctaaaaccgcattggcatttaaacagggagatttagttaatatccgtgatattgaacaatccttggaaaatctcaaacgtgtgccaactgcagatgccaatatcgacattcttccggctgataacagttcagcattcggtgaaagcgatattaaaatcacctatcaacagcggtttccattccgatttagcttaaatttagatgattcgggttcaacatctacggggaaatggcaaggctctgccaccctttcgtgggataatcttttttctgccaatgatttattctataccactttcacacatagcttaaaacatcacagcgataattcggggcgtcgagcaacgagaaactatggcttctattattctattccttttggttattggacactctctgcttcactgtataaaacggattaccatcaagatgtttttggggcgtttgataatacttacctctatgctgggcgtagtgaaacaaccaatttaaatcttgcatatcgtctttatcgagatgcggtacgtaaaaccacaatttcaggcgggttttggtctcgccactcgaaaaactacattgatgatgctgaaattgatgttcaacgccgccgaatggctggttggcaaatcaaccttagccatattgaatatattaaggcagtaacactgaaactttctctaggatttaaatggggaacaggtgtaggtcgcaccatagcggcaccggaagaatattggagaaacggtacttctcgtcctaaaattattaccgcctcggtagacattaattatcctttctatatggggaagcaacccttggcatttaatacgaattggtccgctcaatggaataaaacccctcttattcaacaagatagattgagcattggtgggcgttatacggtgcgtggatttgacggtgagcttaccttatcgggcgagcgaggttggctatggcgtaatgaactcagttggaatattgcaaataaaggacattgggtttacttagccttagatggcggtagagtgatgggacgtagtgatggaatacgattagggcatcatttaatggggacagttttaggtctgcgtggtagttggacgcatttttattatgatgtatttattggacggccattaagcaagccgagcggttttagaacatcgcataccgtaaccggctttaatatcggcttaaccttttaatttagtgcattaggctcaaacgaggattttcttatgaataaacgtcagtttcgtgtgatttttagcaaaacattgcaacctattgtcgtggtttcagaaccggtaaaaaccgaaggaaaaacaaaaagtgagatgcctcaaatgcaaagtgcggttaattttctacccatttttgccgccttaactccccttgtctttcgtttgttctgtgctttgagttttgtcttttcctcgtctgtatttgcggaaaccttaatcatcaaagccgatcccaacgctcccaaaaatcaacaacctattgtgttgcaaacagcgaacggattaccgcaagtcaatattcaaaccccgaatgataaagggctttctcataataaataccaagattttaatgtagacaaaaaaggggcgattcttaataacagccacaaagacacacaaacacagcaagcaggttgggtacaaagcaatccttatcttgctcgtggcgaagcaaaagtgattctcaacgaggtaacatctacacatccaacccaacttaaaggttatgtggaagtggcaggcagaaaagccgaagtgatcatcgctaatccaaatgggcttcattgtgatgggtgcggtacgattaatgcgacacgctcaacaatgaccacaggcaaaccgcagattattgatggacaagtagaaagcattaacatagaaagaggcaaaataaccatcagtggcaaagggttagataacagtcgtgtcaattataccgatattcttgctcgagaagcggaaatcaatgcaggcgtttgggcggggaaaaagcttaatgtggtaaccggcaaaaacaccatcaaacaggcagatatggaacatggcggaaatgatttacaaattacccatattgacagccaaaatctcagtgaaaacgcaccgcactttgctttagatgtgagtgagcttggcggtatgtatgcggggaaaattcatcttgtcggcacagaacaaggactgggggtgcgtaatgcagggcatattggggcaagtgcggacaatttagtgattgattcacaaggtaaaattgtcaatcaaggaatgatttctgcgaagggaaatctacacgtcagtacgaaaaaagaaattcagaaccaagggcaattactcaccgaagctcagctaagtaccaaaagttctcatttggataaccgtggcggtaagattgaaggaagaaccgcacaaattaatgcgaccgagacagtgaataatgatcgcataggttcaacaggatctttgattcaaaccgctgaaaaacttgatattcacagcaaactcgttacaaacaaaaacacgaaagcgtcacaaagtaagccccctgaacaaggtattattgcaggtgtactgacaataaatggcgatgctcttgccaatcaaaacggggcaatttatggcatgcaaaatgttcaacttaatctttcggtacacttggataatcagcaaggcgaaattctctctcttggtgagttacaaattcaaggcgataaacttaatatgaataatgaacatggggaaatcgcaagcagaagtaatttagctatttatgccaataaattagaatctgaaggagaaattgaaagtagccacaatgcgagtattcacctcaagcaagatttaacgcttaataatgctttcaaagtaggcggtaatttagacttccaaacacagggcaattttatcaacaactcagttcttcgtgtgggagagaaactaagcatacaggctcataatatcaataataacagggagagtgagctatctggtaaaaacacccaaattctcagtaatgaaataattaatcgaggattaattgatggtgaaaaaaccttattaaaaagcaccgcactttctaaccttgggacagggcgaatttatggcaatcatttagccattgcgacaccaaatcttatcaatggaaaagaagacaatgcttcgccaaccatcgcagcacgtgaacgattagatttggcggtcggttcacttatcaatcgtgatcatgcgttaatttttagtgcgggagagatgggcattggcggtcatcttaatgaacagcaccatgctgaggggaaagcttcattcattgataatggcagtgcgactattgaggctttgggaaatgcttatgtgaatacagcacgcctacaaaatcacgacttacacttgcgattgggggaaaatcacaccgatgaacggcgagttgaatatgcaccgaaaaatacgtctcgacgctatgtattgatagataaagatggcaatcacgggcgatttgattcaagaaataatagtaggagcgatagaaattcttatttaaggctgaatgacggcacaaccattgcggctaatagttggatgcattgggattataatcgccacactattacgacaacgattgaaaaacgtgatccggctaaaattttgattggcggtgatcttcatttatcaggcaatgatcttgaaaataatgcgtctactctttctgtaggaaaacgcttattactcggtgatgaggtatttataaaaaatgataaaaatgaaacgttacattccacaaccggtacatcgctcaataatattgatattgcaggaacgataaatgttacggacaaaggacattgggatagcttccataaaaagaaacgtcgctatggaataggggtaaggaaacgttgggcggtttatggtaccggaagaggggatttgaatgacattcacccgacgagccatttcttcttcaataaggtagataatactatcggtcagcctgttgacagcaccaacacgcaaattacagctcaagctgaggcgattgtgccaaaccaaatgaatggcgtaattattaacttaccggaacaaagtctatatcagattaaccccgatgcccctaatggttatttagtggaaaccgatccgcactttactaaccgtaaacaatggcttagctccgactatatgtttaacgcattgcgttacaatcacgaaaatgtgcagaaacgattgggagacgggttttatgaacaacgcttgattaatgaacaaattcatcaactcacaggacgacgctttttagataatcaccaaaccgatgatgagcaatacaaagccttaatggatagcggtatttattatgccaaaaaatttaacctgcacctcggtgtcggcttaacagcggagcaaatggcagagttgactgcggatatggtatggtttgtgaataaagaaattacgctaccgagcggtaaaaagttgacagttctcactccacaagtttatcttgttgcacgaaatcttgatgtaacttcacaaggtgctttaatttcagcgagagaaattatggggcatattaacggaaaacttaccaatacgggaacgattgcggggcaaaatctgaccgcactttctgccaagaatatcaacaaccaagggcttgttttgggggattccgtcaatttacttgcaaagcaaaaattagttaacctcggcggtagaattgaagctcttgattcagtgacattagtcggcaaagaaggtgttgacattgcaagtacaacaactcgccgagcttatcaagatgactttggtaataaatttgaccgcactcatgtagataaccttgccggtattcatgtcaaagataaaaacggtaaattaattgttcacagcccaaaagatgtaactattaaaggtgcagaactcaatagtgcaggcggaatacttgttcaagccaaccatattgatattggtacccttaatacaaaaaataaaacggattacaatgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcttctgcctctaaagtgaagcatagtggttttcttcaatccacgacagatatcactaaacacgagcaccattatgatttagctcaagggtcaacccttgatggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgggttcagggggatttggctttagcattggcgaaaagaaaaccaccacagaaaccaatcaaaccaaatattacgccacaggtagccaagtgggaagcctgaaaggtgataccgcccttattgcaggcaaacactaccaacaaaccggtagtaccgtctcttcccttgagggcgatgtgattattggtgcgaaaaaagtcgatattttggctgcagatgaccgatacgaaagccattataaacagacgatggaacaaaaaggttttacgattgcggtgaatattccggtggtgcaggcggtacaaaatgcccttgcggtagcgaaacaagccgaacaggttggcgamagyaaamacwrycgaatcaatgcgatggcagcggcgaataccgcatggagtgcgtatcgagcgggacaagggttaatgcaagcgagtcaaagtctcagccaaatggcgaacggcratatggcacaaggggcgaatgtcagygtrtcyatcacttatggcgaacaaaagaatgtgcagaccacggatatccaaggcaacackgcrgcaaacagtgcgataaatgcgggtggaaaagtcaccgttrcygccaccggagcgggcaaggaatcggatattcacrttgtggggtctgacgtatcaggtcaacaaggcaccctcttacaagcagaagatgaaatcaatgttcknrcagccaaacaaacscaccaagagcggagccaaaataaatccgccggttttaatgcaggtgtagcggtgagttacggctcaaatggtttagcctttggatttaccgcagggggaaattatggcaaaggctatggcaacggcgatgaaaccacctaccgtcatagtcatattggcgataaaggtagccaaacccacatcatgagcggtggagatacgacccttcgtggtgcacaagtgcgaggcaaaggcgtacaagttcaagcccaaaacctcaacattgaaagcctgcaagatactatgacctataaaggcaaacaaatgaatgtgagcggacaggtaacggtgggctatggcttttccgcctccgccaatttcaatcaatcgaaaatcaacgccgattatgccagcgtacaagaacaatcggggatgtacgccggagataaggggtatcaaattaacattgcccaacacactgacctcaaaggcggcttaatcacctccactgaacaagccgaaaaccaaggtaaaaaccaattcagcacaggcacactttcttattcggatattcaaaatcacgctgattataatgggagtgcggttggtgtaggagtacaagcagatattaacggtggctgggatggtcgtcaggttagagatggctcaccggtaagtcgagtgaatcaaggtatcggctttggttatgacaaagamagccaatcyagcstaacaaaaagcggcattaatacgcaaaacctcatcattcgtgacgaacaaggacagttggcgaaaaygggaaaaacgatagaaacaacaagaggggaaatcagcacaaacatcactacggactccgcagagcaacatacaggcaaactggcacaaaactttgataaagagcggttacaaaaagagttggatttacagcgagaagttacgcaaaaatttgatcaaactcggcaggaagttaaggctgaactgtatgatatcgttgatgaaaaacgagaaaaggcaacgcaaattcgaaaaatcaatggtggttatgataccgaactttccgctcaattagatcgtgaggcaacggatttagatgaaaaagtgcgttggttagatatgggattaggtcttttacaaggtagcgtgggaaatagcaaaacaatgttaggtgtttttgcgggcactcaagccgatcgtgccgttcgttcagcaactgcacctaaagaaatgtggtatcacaagaaagtaattaatgaaaaaaccggcaaagtgaagttagaatcaagacaaatttggtcattgaatgatttaagcagagaagaactggcaagcattcaagacacaaatggcaaagttattactgtgtctaatcctggtattttcaatgatcgagaagattcattaagcaacgcagaaaaacaaaatcttaatagtacaaacagcagtggtgtcattgtggttatgaatcctccaacagggaactataaaggctggtggatactgtcttctatggtttctgaactgatgtatgtcggttacgaccaattgaataataaagtgttccaaggctatttacccaaaactaattcagaaaaattgaatcaagatatttatcgagaggttcaaaaaatgggaaatggctggtcggttgataccgacgatcatagtcgtggtggtattacagccagtgttgctttaaaagattgggtaaacaataaagagcaaaacggcattgccccaatcagaaaagcacgtttctatggtacagccacaaatgtgcagaatgattatgccgatgttttacagaaaaacggttatacctatacgggtgaagacggcaaaacttataatagcggagcctactcaatcgtgcatgataaagattttgtggggaacaaatggatacctttcttattaggaaccaatgacacaacaaaaggaaattgtgggatattttgttattcgcacagttcgtattttgcggaagtgcctgaacagcaccaaagggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattcctaaattaatcaacccaaataaaccaaatggagaaaagtatgaaaaaaatcctttctaaatattttatgctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatacaaaaaataaaacggattacagtgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcttctgcctctaaagtgaagcatagtggttttcttcaatccacgacagatatcactaaacacgagcaccattatgatttagctcaagggtcaacccttgatggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgggttcagggggatttggctttagcattggcgaaaagaaaaccaccacagaaaccaatcaaaccaaatattacgccacaggtagccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcgaaaaaagtcgatattttggctgcagatgacagatacgaaagccattataaacagacgatggaacaaaaaggttttacgattgcggtgaatattccggtggtgcaggcggtacaaaatgcccttgcggtagcgaaacaagccgaacaggttggcgacagtaaaaacaaccgaatcaatgcgatggcagcggcgaataccgcatggagtgcgtatcgagcgggacaagggttaatgcaagcgagtcaaagtctcagccaaatggcgaacggcgatatggcacaaggggcgaatgtcagtgtgtccatcacttatggcgaacaaaagaatgtgcagaccacggatatccaaggcaacacggcggcaaacagtgcgataaatgcgggtggaaaagtcaccgttgctgccaccggagcgggcaaggaatcggatattcacgttgtggggtctgacgtatcaggtcaacaaggcaccctcttacaagcagaagatgaaatcaatttacgggcagccaaacaaacgcaccaagagcggagccaaaataaatccgccggctttaatgcgggtgtggcggtgagttacggctcaaatggtttagcctttggatttaccgcagggggaaattatggcaaaggctatggcaacggcgatgaaaccacttggcgaaatagccatataggcgataaacacagccaaacccacatcatgagcggtggagatactgccattaagggagcccaagtgcgaggcaaaggcgtacaggttcatgcccaaaacctcaacattgaaagcctgcaagataccatgacgtataaaggcaaacaaatgaatgtgaaaggacaggtaacggtgggctatggcttttccgcctccgccaatttcaatcaatcgaaaatcaacgccgattatgccagcgtacaagaacaatcggggatttatgcagggaatgaggggtatcaaattaacattgcccaacacactgacctcaaaggcggcttaatcacctcgacagaacaagccgaaaaacagggtaaaaaccaattcagcacagacacattcacctattcggatattcaaaatcacgctgattataaaggcagcagtatcgggttaagtggttcaatggcaataaactttgacacgccgttaggcaaatacggacaagtgcaaagtaataaacaggcggtgaatgacaaaggggaaaaactttacatagatagccaaggcaagcaaaccaccacaagccgagacagtgcaggtaatgcaaaccaagccaaattggcgaaaggtttagattctttaacggggacgacctctttcggattcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgacaaagatgagttacaaaaagagttggatttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgacgtataaaggcaaacaaatgaatgtgaaaggacaggtaacggtgggctatggcttttccgcctccgccaatttcaatcaatcgaaaatcaacgccgattatgccagcgtacaagaacaatcggggatttatgcaggagatgaggggtatcaaattaacattgcccaacacactgacctcaaaggcggcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacaggtaacggtgggctatggcttttccgcctccgccaatttcaatcaatcgaaaatcaacgccgattatgccagcgtacaagaacaatcggggatttatgcagggaatgaggggtatcaaattaacattgcccaacacactgacctcaaaggcggcttaatcacctcgacagaaaacgcagagacggaaaaccgcaaccaattcagcacagacacattcacctattcggatattcaaaatcacgctgattataaaggcagcagtatcgggttaagtggttcaatggcaataaactttgacacgccgttaggcaaatacggacaagtgcaaagtaataaacaggcggtgaatgacaaaggggaaaaactttacatagatagccaaggcaagcaaaccaccacaagccgagacagtgcaggtaatgcaaaccaagccaaattggcgaaaggtttagattctttaacggggacgacctctttcggattcggctatgacaaagamagccaatcyagcstaacaaaaagcggcattaatacgcaaaacctcatcattcgtgacgaacaaggacagttggcgaaaaygggaaaaaccgttgaacaaataaaaacggaaattaaaacggacataaccaccgacaatgccgaaagccgttcgggtaagctagaaaataaatttgataaggaaaaagtcttaaaagaacttaatattcaggtaaaagtaacacaggagttcaggaagaatgcattttcgacgatagatgcttatgtactgccaaaacaggctgaattaagggaaaaaataaaagcagcacaaactgaagaggaaaaagatgaactgtataaggaaatttataaattgcaatatcaaaaacgcttgttagaaacgacagtaggtattattgccggtacacctgagattgctattacacaaggaacgctacaacttgcagcgaccaaaatgcgagaagaaacgctaaaaaattcccgcttatttaaaggaattaaggataaaaagacgggacaaatattgagaaatgacagttacagtagtggttattttgatggcgtgaagttaggtggtgtacgaattgatgttgatgtgatttgtaatagcggaatgggggcttgttctaaaaataatgatggttctataacttttaatggaaccaatgattacacacttaaagatgcaatagatcctacacaaaataataaagcaaaagatttgtatggtcctactggtggattccaagcggttgaaggaggctggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaggggaagtatttccatccatatctcgctatcagaaaccgtatagtttaggaagaactgatagtaatcaacgttggaaagatgtaatttcttgtggtggtaaatatttggattatgatcaaagaagtgttcctttcgagaaacaagaagaattttattattgtatgctgggtaaaggatatatccatctttcccctgcaaaatgtggttatcaaaaccctaaatgggataaaggggtatgtaatttctaatttaaaatgtagatatattacctctgtcaaagatgaaaaagatttaattatgaataaagagagaactatttatgatttaaatagaaataaaagcagcaaataacggagaaatagcaatgaaagtatttagtattattagtgttttccttttgattgggtgctcattcggtggattcaaaccacctaaaccatattatcagtggcgttttgaagataaaaattttgaaacatcttatgaatatgctgtttttagaggcaaagaaatgcgatcttgtggaatggatcctgtattaggtgaaagtgttaaacttaaagtcaatttgtgtatggaaaaaaaaggatggtatctaaaacaaggtccggtgtgtgaggaaaaatatgtatggaatgagccagaatgtattaaatggcgggctaaacacagtaaacctgatgcaaaaccatgggaataataatttacaacagactgaaaggcaattatgttcacctatatcaagaagaataagaaagtattggctgaaatcactgcgtatagaagatatttttaggactaatcaaattttacatcaagaatcaagtaaaaatttgattttaaatggtgcccgagggcggacttgaaccgccacagctcgaaagccgagggattttaaatcccttgtgtctaccgatttcaccactcgggcaagtgtcctgactcggttatgtgatggaggcgtgtcccggagtcgaaccgagctacatggatttgcaatccagtgcataaccgctttgctaacacgccgtagcgtaaattggagcgggaaacgaggctcgaactcgcgaccccaaccttggcaaggttgtgctctaccaactgagctattcccgctttttcgctgcaacacattcgctgtcagtggtgcgcattttacttcgttatgaaaaactgtcaacaattcttttgaaaaaatatgttaattgatgaaaaaaaactcaaaacaggtatttaagaatacaatttatacagaatgtgtttgtttttagtacatcactatcacttatttcatttatctattttaatgatatagaaaatattctttaatcactggaaactttgtgcaacaatgcaatcctattatgtcgtacaataataaaatatagctaaaagtgcggtcgtttttcttagattaattaggtgaagttatgacacaacaatatgctctagatacattactggctcaggccggtaatagaacagatgaaagaaccggtgcggtatctacgccgatttttctttccactgcttatgctcatcatggaattggtgaaagtacgggatttgattatacccgcactaaaaatccaacgagaacggtattagaagaaacaattgcaaaattagaaggtggagatcgtggatttgcctgttcttcaggaatggcggctattcaattattgatgaacttatttacgtcacctgatgaatggattgtttccagcgatgtttatggcggaacttatcgtttattggattttgcccataagaatacgcatggtgttaagcctgtttatgtcaatacagcttcaagtgaagaaattgaaaaggcaatcactgagaatacaaaggcgatttttgttgaaacgccatcgaatccgttaatggaagaatgtgatgtggcagaaattgcgaaaatagctaaaaaatacaatttgctattgattgtagacaatacttttttaactcctgttttatttagaccaatggaacatggtgcagatattgttattcatagtggaacaaaatatattgctggtcataacgacacattagtagggttaattgttgccaaagggcaagagatctgtgaccgcttatattatattcaaaatggtgcaggtcccgtattatcaccttttgattcttggttgaccattcgaggcatgaagacacttgcattgcgaatggaacgtcatcagaaaaatgcacaggaattggcaaactttttaagagaacagccacaagtaaaagatgtgttatatccaaataaaggagggatgctatcttttcgtcttcaaaatgaaaattgggtaaatccttttcttaaagcaatgaagttaattacttttgctgagagtttaggcggtacggaaagtttcattacgtatccggcgacacaaacgcatatggatattcctgaggttgaacgtattgctcgaggtgtatgcaatcgtttactacggttttctgtaggattggagaatgtagaagatattaaagcggatttattacaggcattttctcaactaaagtaaccgtactttaatagatcaagatttaataaaagtcgcaacttatcatacgtaagtaatttgtcgtggtttatgttgtgatttttcacttgaaaagcggagatttatctttatactctctaactggaaataataaatcccaaacaataaaaggaagaaaaataaaaatgagtgaagtattacatacaacagatgcgacttttgatactgatgtattaaaatcagatattccagtattattagatttttgggctccttggtgtggtccttgccgtatgattggacctattctagaggaactttcagctgaattaggtgataaggtaaaaattgttaaaattaatattgatgaaaatcaagcgacaccggctcaatttggtgtgcgtagcattccaacattaatattcttcaaagaaggtaaggctgtcgcaactcaggttggtgcattaccaaaaaatcaattagtaaattttatcaaccaaaatagctaatatgtagcttaaacaagacgaactaaaatagcttaaatctcaaaaggatttaagctattttgtctattacacctttaaatcgtatgtaaaatcataaaacattacctttggtaacggttaaagatttaatatttctttcacaaaaggaatagtcaacttacgttgtgcttgtaatgaggctttatctaataaagttaacgtatcaaataaagacttaatatcacgatctaaacgttttaataaaaaattagctgtatcatcaggtaattcgatccctcgttgatgggcattgcgttttatcacttctactttttgttgttcatttagtggatttagctgataaatttctccccaacttaatcgtgaggcaagatcgggtaaagagatatttaaattcactggagattgattggcacttattaacagtaatgtactcccgctctcttttattctattcattaaatcaaaaatagccaattcccattcatgatttcctattattgcatggaaatcatctaaacaaaccaactcttgctgttctaaattttccaaaacttcaggggaaaaatattgtgctttactcaatggaatataaatcgcattgcgttgcgatgctaaaaaataattggaacatgctttaagtaaatgagttttacctgtactttttcctccaaaaatgtaaaagaaaggttgatataattgaataaaatttttacgtaatgaaccgagtaacaataaattattgtcgctacaaaaattctctaaggtatcatcgtctatctgatgaataggcaaagggagttgttggctcaaaaaataattccatttgatagtaaagttgactcataatacagaaaaaataggaacaggtgaacctattcctattaatcttgtaaattttagtcttctatttgatttttagccgatggtaaaatgagatttagaataatagcgacaacggcacataaactaatccctttcaaggataattctcctaaattgacaaacattccaccaattccaaaagtcataaccacagaaataatacataaattacgtgcttccgtcacatcaactttcccacgaattaatgtactcatcccaacgacggcaatagagccaaaaaccagcatcataattccgcccataacgaaggtggggatcgtagataggaatgctccaactttgccgcaaaatgaaattgcaattgcccatactgctgcccaagtcataatagtcggattaaaatttcgggttagcattactgcacctgttacttctgcataagtggtatttggtgggccgcctaatagtgatgcggcagatgttgcaagaccatcacctaataaagtgcggtgtaaccccggattttttaagaaatctttgccggttacagaactgatagccatgataccgccaacatgttcaactgccggtgcaatcgctattggtagcaaatataagatggcttccagtttaaattctggtgtcgttaaattcggtaaggaaaaccaagatgctttggcaataggactaaaatcgattaatcccataaataaactcaagatataacccaccgcaatgccaaacattatcggtattaatttcatcatacctttggcaaaaactgctacaattaaagtagtcaatagcgtaatcattgacacgagaaccgcatcaccatattcatagttactgcctttgccggtcgccatatctacagccacaggtgccagtcctaatccgataatgataataacgggtccaacaacaaccggaggaaaaattttctgtaaagcccccgctccacgtaatttaaccaacaggcttaaggcaacataaacaagtcctgcacaagcaagaccacccattgttgccggaattccccatgaggctacaccatattggattggtgcaataaaagcaaaagaagaggctaaaaagatcggcactttcttgccggtacatagttggaaaagcaatgtaccaattccggcggttaataaggcagtatttgcgtccaatcctgtgattaatggaactaataccaatgcaccgaatgcaacgaataacatttgcaagccaataaaagcttgtttgattttgcccgaaatttctacggggatattttgatttgtcatttaagtttcaactctctgtctgaattaactaaaagtgcggtctattttccaatagattacgcggaaaaaagcggcattaattgccgcttggtattttggtcttatttcgtaccaaaaatcttatcacctgcatcacccaaccctgggataatgtagccatgctcatttaaatggctatcaattgatgcagtatataattcaacatcaggatgtacagcctctaaagctttgatcccttcaggtgcagcaactaagactaggactttaatatgctgacaaccttttgcttttaataaattaatagtcgcaatcatagaacccccagtggctaacataggatcaacaacaattgctaagcgttcatctaaatcacttgctaatttttgaaaataaggaactggttctagagtttcttcatcacgatacatacccactacactgatgcgggcacttggaacatgttccaatacgccgtccatcatacctaatccggcacgaagaataggaacgacagtgacttttttacccttaattcgatcaatttcaacagcaccacaccaaccatcaattatcactttttcagtttctaaatctgatgtggcttcataagtcaacaggcttcccacttcagtggctaattcacggaaatcttttgtagtaatatctgcaactcgcatcaaacctagtttatgttttactagtggatgtttaacttcaacaattttcatcgcatgcttccttattgatcgattatgtaaaaaaaatccaaacggcggaattctaaatgatcttgattaaaattaatagtattgaaagaatgttttaataaaaaactgcaatatgcagatgcagaatatttattttaccttaggcaaactgttgcatgcctagagtgccgtcatcaataatttcagactctatgcctaagatttctgctactttatcaccttctttaaacatcacaaaaccgccagattccattttattccaatgttcatctttggtaagtgggaacgttgtaataattgttactttatctgtttcttttgcatagtcacgaaaatcaataatattatcatcgtctatgcgttgtgcttttccgaaaggtgccttacgagtgagatagtgtaaatttgttgaacagtgggccatcatccactcaccattagataggataaaattaaatgtgcctctctgtgttaattcttgtgtgagtttttgaattgcactaaacatatcttgttcattaggctttttgggaaaacgtttctttagttggctaagcatataacaaaatgctgtttcggaatccgtcgagcctatcggttgaaaaagactttctgtcatatcgggtaatgaatttaagttgccattatgagcaaaaacccaattttctccccaaagttcacgaataaaagggtgagtattttcaatattgacctctccttgtgttgctttacgaatatgtgcaacaacatttaaagattttatgttgtattgtttaatacaatcagcaatgggagaagaatgtccgggacgattgtcgcgaaaaacacgaattccttttccctcaaaaaaggcaattccgaaaccatcggaatggcaattagttaatcctgctcttcgacgaaatccctcaaatgaaaaaacaatatctgttggggtattacaattcattcctaaaagttgacacataatttatttcatttaacccaattttatgtctttttatctacacaatgagtatgaatttaacaaaaatacagattaaaaatcaacatggatcttagatcaattagttacataaaatagctaaaaaaacttaccgcaccaagttttcacaaggtgcggtaagcaaataagaaggtttaatataaaatgataaggattagtaaacaccttgtgctaacattgcatcagctactttaacaaagcctgcaacgtttgcacctacaacatagttaatatttttttgcccttcgacagtaccgtattttttacaatttgcatgaatatccaacataatacggtgtaatttttcgtcaacttcctcagctgtccagtataaacgttgtgagctttgtgccatttccaaaccggaagttgcaacgccaccggcatttgccgccttaccaggtccaaataaaacgcctgcttccaagaatgcgtcggtagcttcaattgttgttggcatattggcaccttctgcaacaagttgaaccccgttggcgatcaattgttgtgcatcggataattccaattcattttgggttgcacaaggtagtgcaatatccgctttcactccccaaggacgagctccctccacgtattgcaaaccaaattgttcagcgtaatctttaacacgaccacgttttacatttttaatatctaaaagtgcggtcaatttttcttgtgtaaagccttcaggatcataaacatagccggagctatcagaacaagtgacaacttttgcccctaactgcaaggctttttcgatagcatattgagcaacgttacctgaaccggaaactacaactgttttccctgcgaaagattgtcctttttcagcaagcatagcttgagcaaaataaactaaaccataacctgttgcttccggacgaattaaactgccaccaaatgacaaacctcgaccggtaaacacgcaagctgcttggttagataattttttcatatatcctgcaagataacctacttctcgtccacctacaccgatatcacctgccggtacatcggtatctgcaccgacatgacgatataattcagccattaatgcttgacaaaaacgcatgacttccgcatctgatttacccttaggatcaaaatcggaaccacctttaccaccccccattggtaaggtagttaaagcatttttgaaaatttgctcaaagcctaaaaattttaaaatagataaatttacagatggatgaaaacgcattccacctttaaacggtccaatcgcactattgaattgaactcggaatgctcggtttacttgcacttgacctttatcatctgtccaagcgacacgaaattgaaatgcacgttccggctcaactaaacgctccaataaagcttcagagcgatattttggatttttctctaaaaatggccaaatggaagtgaatacttcacgtactgcttgcaaaaattctggttgatgaccgtcacgttgttctacttttgctaaaaaatcttctaacgatacgattgctgacataatttgtttccttcttaattgaaatgttttgtttgcttatttatatagagagcctttatcagcccacgattaatatgcaataaaatatcaaaacattgcaactaaaattattaaaaaaaattaaaaaactatttaaatattaaattttatttaaaataattgtatatattttaaatttattttgattttagttgggttaatagaagtaatatcaaaaagcaggaggaaaaaactaccgcacttatatattctaaattgaagaatttacagcaaaataaaaactggagactatgtttatctttatatgttaagtaaaaaatgtaaatattagtttcattttgaagaaatttattacacactatatgggcaaattattttgcaactatttttactttaggagttattatgaaaaaagcactattaacagcattagtattaggcacgagtttaactgttactggttgttttgataaagacaacaacgtttctcagcaagcagaaagtacaaaagaaagtgtatcaacagcaattgctgaaacaaaagaagctatgtcagaacaagtaacggaagttaaagagacagcagctgaaaaagttgaagtagctaaagaagctatgtcagaacaagtaacggaaattaaagagacagcagctgagaaagttgaagcagctaaagaagctatgtcagaacaagtaacggaagttaaagagayrgcrnctgaaaaagttgaagcagctaaagaagctatgtcagaacaagtaacggaagttaaagagatggcgactgaaaaagtggaagcrgctaaagaagctatgtcagaacaagtaacggaagttaaagagatggcgactgaaaaagtggaagcggctaaagaagctatgtcagaacaagtaacggaagttaaagagatggcggctgaaaaagttgaagcagctaaagaagctatgtcagaaaaagtaatggaagttaaagagatggcgactgagataaaaagtgcagtagaaaaatagtctatattgggttagattttctttaatgattagagctagaatgattgttttctagccttttttctttataaattgagattaagtttgtctttttatccaaatttgttagaatcagtcagaattttggggctgattttggattcgacggaattagcgaagcccaaggtgcacgtcgaggtgcggtaggcctcgtaaataaaccgcaaaacaatagtcgcaaacgacgaacaatacgctttagcagcttaataacctgctcatagccttcactccctagctttcgctcgtaagacggggataaagtggagtcaaatccaaacgagatcgtgttgaagccgccgctttaggatcgaagcattaaattgaataaagctagttttttgatggcgtgtctgtccgcagtcaatttacgaaattaaagattagactaaacgtgtaggactgaaggtagagtaatttcggacgggggttcaactccccccagctccaccatatcattcgaaaagaaaatttctagacattttgaaccgcattgaaaatgccaattttggcgtaactttttgtttttaatctttttagtgaaatttgttaacaacttaattttattaacaaaatttatttggcttttagaaggtttacggcacatcttgttaagatgttaaagaaaaaccgaaagaaaaacatttactaattgatggctaagggttgttctgaaaaactaagtttggcgatgttaaaatttgactaattaactctattagaagctagttatatcataactagcttctcgtttttatctccaaattaaattactttttcttgtaattgtagtttggaatagcggtccagcgttttttgaattctttaacgacttgttttggttgacgattgcgtgagaaaagccctttatggtttccttgtatacggtaaatcataaggtttgtttcaaagtctgcaaaattccatacttgttccccaacaagattagggatgctgtcaaaaacactatggctcatagcataaaaatcacattgaaactcttcggtataaggaatatcccacatagaatgtaagccaggtaaagtatctgcaccatattctgtcataagaattggtttatctgggaatttactttgccattttaacaactcttgacgaagtccagcttctcctttagctaaatcaccatgatctacataccaagcatagtatcgattcaaagaaatgacatctaccaaatccattacttcatcacgctctggcgttgccagtaaaatattgactaaggtaacaggacgtttttgcggatccaattccttataaagagcaactaatggtttgaaataatcatgagcacctgcttcatggctggctggttcatttgctactacccacatgacaactgaagggtgatttttatcacgttttaccaattcttgaatcgcttgttcatgtgcttctcgggttttcatagcagaccaagtgccgttatctttgggatttaaatcaagagaagcggtaaagttttggaaaagtccaacggctggaatttcatcaattaccaaaactcccatgcgatctgcaagacgcatcatttcttcagaataaggatagtgtgaggttcggaaagagttggcaccaatttctttcaaaaggttcatatccatcaagtttgctgcttcgtttaaacctcgaccattgataaaggtatcttcatgttttccaaaacctttaaaataaacaggtttttgattgacaaagaattgaccatctgccacatgaacactacgtacaccaaatggctcatcataggtatcaacaactttaccatcaacaagtagctcaatatgtgcggtataaagataagcatctaaaacttcccataagcgtacttgttcgagagtgatatgcccgttacttgattgtgcaactacttgacgatcttcatcaagaatagttacttggattgtgtcaactgcctttgatgtttcaacagcaatagaaagttttgccgtctttaagtcatctgaaagctcactgacgatggtaacatctgaaatgtgaattttaggacgtaccattaattttactgggcgatgaattcctgcatagttgaagaagtcaaagttttctttaaccacttttttaatactgccatcttcttgagtctcttcaatgtaattaccaacaggaagtgtggtgtaatctaagatattattggcacagacagagatttttatttgattttcttggtaaagatcctctggaataattacctcaaacggagtgaatccacctttatgagaagcaagttctcgaccgttaacataaattttggcattgtgagttaccgaaccaaagcgtaaaactaactcatcattttccgctaatttgggaatatccacccaacgctcataccaaaaatctccaatataattacgcttatctttgtcaaccaccacgtcattaaaggaagttggtactaccattacttcttctggtgataaatccttttcgggattatgctctcctagtttaaattgccataaaccactaaggtcatataaacttcttgtttttgttaacgttggatataacatatattttctcctttgtgtttcttaacgtttaatctcgtgggaagtctcatctagcaattgatcaatatctgcttgagaaatcacattaatatcgccttcaatggtgtgtttgaacttgaaacttgccatagcaatggccaaacttttttcaggactttcttttttaagcatgccatgaataattcccgctgtaaaagcgtctccagtaccaacacggtctaacacttgaatgcctgatttgtctgtctgataaagatgaccatcctgatataaatagcctttcaatagatattcattagtatgtcccatttctctttgagtaaaagcaaagcttttcacgctataagttttagctaatttatccaaaatgctttttaataattcttgatcttcgtaaggtcttgttaaacctaattggtcttttaaatctccttgcccatcaccggaaagacttaacggctcaattccaatgcaaacatctgctagagcggcaagaggggacaataattctcttgcctcttggaaagagttccataaacttgctctaaaatttaaatcaaaagagacagtgagtccctctgctttagccttggtcatcaaataatgggttaagctataaaggttatcattcaacgctggagtgatgccagacacatgaaaccagtcggctcctttgaatacagactctaggtcataatcactcagttgagattcccaaaaagcagagtgttttcggtcataagttacccgactggcacgtaaggaaaagcctttctggtaataataaatccctagacgttgccctttttccaaaatgtaatcctgattgatttgacgagaaaaaagaaagtttttcgtcatcctacctaaatcattatccggaatggcagatataagagaaacgttgtgtcctaattgtgccaaggttgaaagaacatttaattctgaaccgccaaattgacattctagactggttgtcagtgttagggtttgatactgtggtggtgataaccgtaacaagatttcacctaaagaaactactgttttcaactaaaacctccatcttgatgggttgtgctaaaagtagtatacacgatattatgttttttagtacaagaaagtgggctacagtaaaaaataagttatatcatcatcgtaacagactgcttatttagaattcttaatatctattagattattagattgttattcgcattgatttgtcgataatcttcaatgcagtgatgttttaaaaaaacaagcatattctctttataagatgtttagaaaaatctcttttgttttttgtcgtgtggagtgacaaaagtgcggtgtcttttggtgtgtccttagaaatactttacaagtgttgattaaataagttcaaagatagccagcaaaagaattattttagaaatgcagtaaaaattatcatttatgccatagaaatattaacagaaattagtaatttaaattgagattaacgacagaaaatagtaaagtagcccactattcattcacttacaaaaatagcttttaaggcggaatttatgggaaaaagtgttgttgttttaggtgctcaatggggcgatgaagggaaaggcaaaatcgttgatttattaacagatcgagttaagtatgtggttcgctatcaaggtgggcataatgcggggcatacattgattattaatggtgaaaaaacagttcttagattaattccatcaggtatattacgtgaaaacgtaacctgtctgattggaaatggggttgttctttcaccgacagccttaatgcaagaaatgggggaattagaaagtcgtgggattaatgttcgtgaacgtttgttaatttccgaggcttgtccgttaattcttccttaccatgttgcaatggataaagctcgtgagtcagctttaggcaataaagcaatcggtaccacaggacgtggtattggtccggcttatgaagataaagtcgctcgtagaggcttacgtgttggcgatttgtttgataaacaatcattcgccgaaaaattaaaaaatattctagattactataattttcagttagttaattattacaaggttgaggctgttgattatcaaaaaacgttggatgaagtacttgcagtggcagatattatcacagctatggttgcagatgtgacgacaattttagacgttgctcgtaaaaatggcgataacattttatttgaaggtgctcaaggcacaatgttggatattgaccaaggcacatatccttatgtaaccagttctaacacaactgctggtggtgtatccactggagcaggttttggtcctcgtcatattgattatgttttaggtattattaaagcctattgtactcgtgttggtgggggaccattcacaacagaattatttgatgaagtgggagcggaaattgcacggaaaggaaatgaatttggtgccgtaaccggtcgaccacgtcgttgcggttggtttgatgctgttgctattaagcgagcaatccaaacgaattctatttccggtttttgtatgaccaagctggacgtattagatggatttcgtgaagtcaaaatttgtgttggctacaaaatgcctaatggtgaaattgctgaatatgcaccattagcggcaaaagattgggaaggtgtagagccgatttatgaaaccttaccgggttggcaagaaaatacatttggtataacagatgttaatcagttaccggaaaatactcgtaattacattaaacgtattgaggaagttacgggcgtacctatcgcgattctttcgacaggtcctgatcgtgttgaaactatgattttaaacgatccttttgcggtgtaaatcataaataatagagacaaaagtggtttaattcagaaatgaattaagccacttttttatctcaatcaacttcctgaaatcttcattttttccaacaaaatcgaacctgtttgaatattcgatctatattcaatatcgttaccaaccgcaataatatttgcaaacatgtcttttaattgcccggcaatagtgatctccgatacaggatattgaatttcaccattttcaacccaaaatccaaaagctccacgtgaataatcaccggtaataatattaaccccttgtcccattaaatcagtgaccaataaacctgttcccatttcttgtaaaagtgcggttaaattttgtgaatttggcttaaccagccagttatgaattccacctgcatgtcctgtactttgcatacctaattttcgaccgctataacttgtcagcaaataggtttgtaaaataccttgttcgataatttctaaatttttcgtacgaacaccttcaccatcaaaaggtgttgaagcaagtttgccaatcaaatgcggtctttcactaatatgaaaccaatcaggtaatatttttttacccaaatgatcaagtaaaaaactcgagttacgatataaacttccaccgctaatcgctgttgccaaatgtcctatcaggccggttgccacactattcatgaaaataaccggtgcttcttgagttggaatttttctcggttgtaaatgagatagtgcttttttggcagaattttcgccaacccaaaccgcactttccaactcttgaatattacgtgcaacagtatattcataatctcgctcaagttgttcgttgctgcttgcaatcacagaacaagataaagaataacgacttgataaatagctttgtaacatgccgtggctattaccataaactcgcacaccggtatgcgaattaaatgttgcaccttcactgtttacaatgcgtttatcataatctaaagcggctttctctgtttgcaaagccaatgaaacggcatgatcaacatcaatatcaaactcatgataaagtgctaaatccggtgcatcaaatgccattaattccttatcagctaaccctgcacaatcatccggagaggtatatttcgcaatagctaaggcggaatctaccgcactttttattgcggtatggcttaaatccgaagttgaggcatttcctttttgattccccaaataaacggaaatacctaaagcaccatcattgttaaattctacattttcaatttcctgtaaacgagttgaaacggataaaccattgacttttgtaactgcaacttctgctgttgcacctgcttgcgtagcagtttcaattgcatagcttacagcatcttgtaacatttgctcttgttgctttaaaagtgcggtggaattttgttgagttatcattataagcctttttattaaacagaaattttggctattttagcttattttcaaatttgtcgctaaccacaaatactatgtcatttcggcaaaatgtgaagttatgctaaaatacgccgaattttacataaggaaaataggaataaatcatggcgaaatgtaaagaagaagtgtttaattgggaagatgaggaacaagaagaaattatttgggtgagtaaaagtgaaataaaacgtgatgcggaagctttgaaaaaattaggtgaaaaactcgtcaatttaaccaaaacaaatttggataaaataccattagacacagggttgcgtgatgcggtcgaacttgcacaacgtttgcaaaaagaagctcttcgccgtcaaattcaatatatcggcaaactcttgcgagccattgatccggaaccaatccaagaagcgttaaataaaattgaaaataaacatcagcagcaacaagcaatattacataaattagaattattacgagatgaattggttcaaaaaggtaacagtgcatttacagagctattaatacagtatcctcatgcagatcgccaacatttacataacctaattcgttcagcacaaaaagagcgggaacaaaacaaaccgcctaaatcataccgagaaattttccaatatttgaaagatctgattttggaagattaacatgaaaatccgcatgttaaagtgcattaacgtttatctgctatttttcacatgtaccaaaatccgctataatggcggacatttttgatataacgtacctaataatgtaaaaaaaccaaagaggtttattatgactactccagtagttgctctagtcggtcgccctaatgtcggtaaatcgactttatttaatcgtctaacacgtactcgtgatgctttagtggctgattttcccggtcttactcgggatcgaaaatatggtcaagcacatttcaatggttatgactttattgtgattgatacgggaggtattgatgggacggaagaaggcgtagaggaaaaaatggcggagcaatccttacttgccattgaagaagccgatattgttttatttcttgtagatgctcgtgctggcttaacttctgcggatgttggtattgctcaatatttgcgtaaacgccaaaataaaactactgtacttgtggcaaacaaaaccgatggtattgatgcagattctcattgtgcagagttttatcaactaggcttgggtgaaattgaaaaaattgcggcatcacaaggacgcggtataagtgcattaatggaaaaagttttgccacctgttgccgacaagctaagtttagctaacgcagaagagcattcagaaagtgcggtagaaaattcagatgaaagtgcggaagaatgggaaaaagattttaattttaatagcgaagaagatatacagctacttgatgaggctcttgtagaagaacaagaagaaagtgaagataaaaatatcaaaattgccattgtgggtcgtccaaatgtaggaaaatcaacactaactaaccgcattttaggtgaagatcgtgtagtggtgtatgacttaccggggaccactcgagacagcatttatattccaatggagcgagatggtcagcaatacactctcattgatacggccggtgtacgcaaacgtggtaaagttcatttaacagtagaaaaattctctgttatcaaaacattacaagctattcaagatgcgaatgttattttgttgacgattgatgctcgtcaaggcatatccgatcaagatttatcgttattaggtttcattttaaataccggtcgttccttggtcattgttgtcaataaatgggacggtttaaatcaagatataaaagatcaagtcaaatctgaattggatcgtcgtttagactttattgattttgcacgtgttcattttatttctgctctacatggtagtggtgtaggcaatttatttgacagtataaaagaggcttatgcttgtgctacaaaaaaaatgacaacatcattactaacccgcattctacaaatggcaacagatgaacatcaaccgccaatgataggtgggcgtagaattaaactaaaatatgcacatccaggcgggtataatccaccaattattgttgtacacggcaatcaaatcgaaggtttgccggacagctacaaacgatatttatctaactattaccgtcgtagcttaaaaattattggatcaccgattcgtttattgttccaagaaggaaacaacccgttcgcagggcgtcgtaataaactgacaccaaatcagttgcgtaaacgtaaacgtttgatgaaatttatcaaaaaatcaaaacagcgataaatataatataaatgggcggaaaatatccgcccaaaatcactgcactttgcctctatattttttcttattttgcgatctctctcgcaaatatttcccaattcaataaactttcaactttttatcttttatattaaagcctttccacacaaacggatataaggataattatgcgagtattagcactattttttatgttgttcattataaaagttcaagcaacattgccggatttcatgctgttggaaaactataaaaatcaggacgtaagcggttgggtgatgagtgaaaagttggatggcattaggggatattgggatggtaaacaacttttcactcgacaaaataaagtcattcagccaccgcactattttattcgtgatttcccaccctttgctattgacggcgaactttttaccgaacgtaatcaattcgaaaaaatatcctctattgtacgttccaaaaaagataaaggttgggaaaaaatgaaattatatgtttttgatgttcccaatgcacaaggaaatttatttgaaagactggctgttttacaagattatcttgataaacatcctacaccttatattcaaattattgagcaaattcccattaaaactaaacaacaagtgaaaaattttttacaacaaattgaaaaacagcaaggtgagggagttgttttacgtaatcctcatgctacctatgaacgaaaacgcagtacacaaattttgaaattaaagaccgcacttgatgaagaatgtactgttatagctcatcatcaaggtaaaggacaatttgaaaatatgctaggatcaatcagctgtcaaaatcatcgtggcatttttaaaatcggctcaggatttaatttaattgaacgtagaaatccgcctccaataggctctattattacctataaatatcgtggattaactaaaaatggacttcctcgatttgccacttattggcgttcaaagaaagaataaaagtgcggtgatgattgatataaaatcttcttatggggctgatattttcctttacaagccgtaaaatctgcctaaaataaagcccccaaatagcttgcatagtcaagctactgacttgtaatcagacttaagagaaaatttatgacaactcaattcaaaccggaattattatctccagccggttcgttaaaaaatatgcgttatgcttttgcttatggtgcagatgccgtatatgccggtcaacctcgatatagtttgcgagttcgcaacaatgaatttaatcatgctaatttaaaaatcggtattgatgaagcacatgcacttggtaaaaaattctatgttgtagtgaatattgcaccacataattctaaattaaaaacctttatcaaagatttacaacccgtgattgatatgcaacctgatgcactaatcatgtcagaccctggcttgattatgttggtgcgtgagcatttcccaaatattgatattcatctttctgtacaagcaaatgcagtgaattgggcgacagtgaaattctggaaacaattgggtttaactcgagtgattctatctcgtgaactctccttggaagaaatcgctgaaattcgccagcaagtaccggatattgaagttgaaatatttgtgcatggtgctttatgtatggcatattcaggacgctgtttattatcaggctatattaacaagcgtgatcccaatcaaggtacttgtaccaatgcctgtcgctgggaatattctgttgtagaaggaaaaacagatgaagtaggcaacattgtgaatgttggtgaagaaattcccgttaaaaatgtcgcaccgacgttaggtgaaggaaatacaacaaataaagtctttttattagcggaaaatcagcgacctgaagagcaaatgtcagcctttgaagatgagcatggtacttatattatgaactctaaagatctgcgtgcagtgcaacatgtagaaaaactttcacaaattggtgttcattctttaaaaattgaagggcgtacaaaatctttctattattgtgcaaggacggctcaagtttatcgcaaggctattgatgacgcagtagcaggcagaccttttgatgaaagtttaatggatacattggaaagtttggcacatcgtggctatacagaaggtttcttacgccgtcatacgcatgatgaataccaaaattatgattatgggtattctatttctgaacgccaacaatttgtcggagaatttaccggtaaacgtaatgaacaaggtatggcggaagttgcggttaaaaataaattcttgttaggtgatgaagttgaattaatgacgcccaaaggcaatgtggtttttaccattgagcgtatgcttaatcgtaaaaatgaacacattgatgccgcacttggtgatgggcattttgtttttttagatgttcctcaagatattcaacttgattatgcgttactcatgcgtaatttagttaatgcaaatacaagaaatccgcataataaaaaataatcgtttgttagaaattttttgtgaatgtaaaaaatatttcgccctttcttgatgaaagggcttttttaccctctgtttatatcacctaatttatcagacagtgctatcgggcaacgcaagtgctatacccgtagcacttgccgattgccttagtcttgtagcactaagggggtgatttatgttctaaccattcttgacctaatcgcttatctagtaactagattgtcctaagacaatcggaaggggtgagatggtaactcgccccgacctattcccattgtatgccctatcccctgatttttcaagttatctacttttcaaataatcttattcttaattcgtctagagttttaatttctccagaaacatattttttcagtaatacttcacattctttagatggatattccccttctaatgcaaaactggctaaggcgttttttatatgaaattcccgtctagttaaaatttcaggtgttaatttttcatcatcttgcataaatccccctaaaatttatatttatgaaatttttttctcactaacttagaaagttcttcgtagtcaatttcttctggtttaagagcgtatagcttgttacgcaagccggctaataactcgctatcttcgtttctaccacctgtttgagccacgattaagccgagtgtttgggaaatgccattgattaaactgtctttttccatgagtgttgccataattctcccccttgttttatttgaaaaacctttaaaaataaccacttttatttgccaaagcaccattagaacatttattaaatcaatctggcgtgattttttgtcaagaaaaaattgcttttgatcacgtaaaaagcggaaccattaatgatagcaattattttgtttattatggcaaagtagcatcattggaacaacattttcaattgcaaggcaaaaattatacttgctacgctttttctaatcctccttacccttttgttagaccagcaatttttgatgatgaactcaattttttagagcaagcactctcaaataaaaacaaaattgataaaaagaaagcttttgtattttttaaacgttatgccaatcaaccgatttgtgttggaaacttccttcaaaaactatcctatctcctctattttcgttggggcagtcataacattattggcaactttgattttttctgcactggcatggctcattagttccattattttcttctggcaacaacacaaaattccctctgagtatcgacaaaaaatgcgtaaccgagaaccatttcaacgcttatcgaaaattgtgcctcttgttttttaggtgcgggtatttatggtgcggtcgccgctcacgatattctgccaaaatggaacggatttccacaacctcaaatccaacaactttctacgcagtattgctcagccaattggtgccaaaatctttccaaaatcaacatcaaaacaaggacgctaccagctggagtttatagtgcggaagaaaaaacgcgtattattcaaaaaaccttagtcaaaaaaggttacaaacttaaagtggacggaaaatttggtgcaaaaactcgcaatgccgcagtaagttaccttgcgaccaaaggtatcagcgtcactaacgatatcgccttggatcggttgtttgagtattttgaaccaaacttacagtaaaatacattattttgaagtattgtatattgatagaatgtttattctaatatatagctttttgtatgacttaaactctttttaacgtgcctatttctttgctttaattacagatgttcttgtatattatagtttttcatatctgtgatatttatcacaaaaacgaaataaaaattccaaattttaataaaaatgaaaattttgcattgaaataaaagtagcaatattgtattaatatcaaggtatttaagtggttcaatattacagtctgatcactaaatagagaagttcattgctaaatttaatatttacatatgctaaaattgataggaaaattctatgaaaactgcaaaaaactgcaaaaaactgcaaaaaactgcaaaaaactgcaaaaaactgcaaaaaactgcaaaaaactgcaaaaaactgcaaaaaactgcatagcattcttttaactacgctacttatctcccttcctgtactatcacaagctaaaaccctaagattggctcatcatatggctaatgataatgttaaccatacactagttatagatttttcagacaaactcaaagaaatatctaatggaaaacttactgttgatgtttactcaaacgggattttaggcgatcaagtggagctatttgaaggaatgaagcttggcaccgttgatatgtccatctcagatactagcatcattgcttcttattattctccaattgggattttagatatgccttatttttttaaggatatggagcatattaaaaaattactaaatacagccaaaatggcagaaattaaaaaacaagttgaagccaaatcaggggttaaaatattaagtattcaacctgtcgcttatagaaatattattcttaaaaaagaacttgctgataataataaatttgatggcttaaaaattcgagtaccaaattctcctgtacttgttaataccataacttctcttggagctacaccaagtccaattccatcaggtgaggcatacactgctatccaaacaggagttgtggatggtatggaaggtaatccggaatttttaagctccattaaaatcagcgaagtagctaaaaactggtatgagacacaacatgccatgacttttactgcgttaaatattagtgctaaaaaatttaattcattaacagaatctgaacaacaatggattaaagaggctgtaacttttgcaatagatcagttttatattaagactgtcaacactgatgaaaaatggagaagttatctaaaacaacaaggtgtcgagtttcataatgtagatataccaactctaagagaaaaagctaaaccaatggttgataaatttgttcaagcaaacggattagaagaattatataaagaggcacaaaaatgaaactagatggttatatttcctcatttagaaatacattaacgattatacttttttctgcacttgtcattgttgtatctataggtgtgttttctagatttttaacatcacatcctttcgcttggactgaagaactgtctagatttatttttatttggttagcttggatagcttcaagtttaacaattgctaagggtattaatattacctttgatattgtgctggataaattagaacaaaccgttggtaatattgctcatattattgtgaatgttatttctgtcatttacatactcgcagtcattatattgggatacatactttgtattaataatacaaattcatattcccctttactcggtgttccaatgtggactctaaatcttgcgatacctgttggtggggtattgatggtttatgagcaaattaaaaatttaatcaagaaacgttaattataatgaggtgatatatgctacttcttgcattcttatgcttctttattttggttctgctcggtgtgcctattgcattttcaatgggattaggtgccataatttcaattctgtctaatgatttaccgttagcattgatttctcagcgtttattctcaggtataaattccttttcattattagcaattccgttttttatgttagctggagaattaatggagaatggaggaatatccagaagacttattcatttatcgaaatgtttagtcggacattttagaggcggtctaggtatgatagatatatccacctctgtaatttttgccggagtatcaggatctgcagctgcagatacagccgccgtcggttcaattatgatacctaccatgaaaaaaaatggctatccagcaggcttaactgcagtccttcaatctgtagcaggatctcttggtccaattattccacctagcttaactgcgattatttttgcctcattaactggattatcaattaaagatttatttttagcagggattttacctggaattgctatagctatcggattggttctagtcacctatttctatgctaaaaaatataatcttggtagagatcaaaaggcatctagagccattttatgcaaagcatttaaagaggcgtcttctgcattatttatgccggttatcatagtaggtggaattttggttggcttctttacgccaactgaagctggggctgtagcagtactttatgctattgcagtcggtatttattataaagaattaacttttaaaaaattcaaacattcaatactaaatgcagccgcaatgaccgcaatgtgtaccctaattatatcgggagcaactattttatcatggattatcgccttcactcgtttgcctgatttaattatagggttcttaacaagtattacggataatccttacatgatccttctgctcttagtagcatttttattatttatcggcatgtttattgaaactattgccgcaactattattgttgcaccaattttaatgccagtagcttatcaatatggaatagatccgatacaatttgccataattatgatcgtggtcttagtttatgcaggtgtaacacctcctgtcggtggagtattgttcattaccatggggattgctaatgtcaaactacaggaaacgctaaaatacctcgttccttatttaggtgtcatattcatcgttgtgttactgatgatattattcccttcgatctctttgatgatacctaatatgttccgttaaaaaacaagtgagtataatgtgtttttcattttactcacttgatggcgataatgacacaatttcctcttgtatgaacccatatttgcgactagactacgcccttacagtttttattatgattttacgaagttatgtatttatctgatttctattttgacttacctgatgaattaattgcacgttatcccaaacgtgagcgttcttccagtcgtatgttgcaattaaacggacaaaacggagaattatttcaccgcacttttagcgatgttgcagatctgattaacgaaggcgatttgctgatttttaataatacccgagtgattccggcgagaatgtttgggcgaaaagcaagcggtggaaaaatagaagtgttggttgagcgggtactaaatgaacatcattttttagcccatattcgatcttcaaaatcaccgaaagaaaatacaatgctttttttaggtgaagataagttgggagaagggaagggtgttgaaatgctgatgaaggcacgccatgaaaatttatttgaactggaattaagtgataaaagtaccgctcttttagatattttacagaaaataggtcatatgcctttacccccttatattgatcgtccagatgaagatgccgataaggaacgctatcagacggtctacaataaagttccgggggctgtggctgcaccaactgccggcttacattttgatgatgagctattgacacaactcaaaaacaagggggttaattttgcctttgttaccttacatgtcggtgccggcactttccaacctgttcgtgtagaaaatattgaagatcataaaatgcacgcagaatatgtggaagtcccgcaagaagtggttgatgctgttttagccacaaaagcaaagggtaaacgagttattgcagtaggtacaacttctgtacggtcaattgaaagtgcggcactttttgccgaagaaaataatagcactcatttacttgaaccctatttttccgacacttccatttttatttatccgggcaaaaaatttcgtgttattgactgtttgattaccaatttccatttgccggagagtactttgattatgctggtttctgcttttgccggttatcaacatacgatgaatgcttataaaagtgcggtcgaaaatcgctatcgcttttttagctatggcgatgccatgtttattacgaaggcctaaaagccgattacatcagactgtttatctgacgagaaggattacaaatgacaatgaaatttaccttacataaaactaacggtatggcacgtcgaggtaccatgacttttaatcgtccgcagggcgaatttacggtggaaacgccagcttttatgccggttggaacctatggcacggtaaagggcatgacacctgaagaagtgcgggcaacaggggcagaaattttactgggaaatacctttcatttgtggcttcgcccgggtcaagaaattatgcgtcaacacggtgatttacacgattttatgcaatggcatcgtccaattttaaccgatagtggtggttttcaagtttttagcttaggtaaattgcgtaaaattactgaagaaggtgttaaatttcaaaatccaattaatggcgaaagaattttcttatcaccggaaaaatctatggaaattcaatatgatttaggttcggacatcgtgatgattttcgatgaatgtacaccttatccggcaactttcgattatgccaaaaaatccatggaaatgtctttacgttgggcaaagcgtagtcgtgaacgttttgatgaattaggtaataaaaatgccttgttcggtattgtacaaggcagtacttttgaagatttacgtaaactttctattgaggggttaattaatatcggttttgacggctatgctgttggtggattagctgttggagaacctaaagaagatatgcacagaattttagcatatgtttgcccgcaacttccggcggataaacctcgttatttaatgggtgtcggtaaaccggaagatttggttgaaggtgttcggcgtggtattgatatgtttgattgcgttatgccaactcgtaatgctcgtaacggtcatctttttgtcagtaacggtattgtaaaaattcgtaatgcaaaatatcgtaatgacacaacctcccttgatcctgaatgtgattgctatacctgtaaacactataccaaagcttatttatatcatctggataagtgcggtgaaattttgggggcgagattaaataccattcataatcttcgctattatcaacgtttaatggctcaaattcgtcaagcgattgaagaagatcgttttgaggattttgttgtagaattttataaaaaaatcggtaaatctgtgcctgcacgataagaaagtaataataattgtcggagaaataacctacaaggtcggttattgataaataaagtgcggtgaaataaaaagatattttcacattaaaagaattttatgctattttacgcaagtttttaatgaatgtttaactcacttataaggataaaataatggaagctcaacaaagtagcccactttctatgttatttatttttgccatttttggattgattttctattttatgatctatcgtccacaagcaaaacgtagcaaagcacataagcagttaatgtctgaattagcgaaaggcactgaggtgttaacttcaggtggtattatcggtaaaatcagcaaaatcagtgctgaaaacgattatgtcgttatcgcattaaatgatacgactgaaatcactatcaaacgcgattttatcgtagccgtattgccaaaaggttctttaaaatctatctaaattttcattcattccgcaagggaacaagtctatgttaaatcgttaccctttatggaagaatctaatggtgatcctagtgatcgccattggtgttttatattctcttccaaatctttacggtgaagatccagctgtacaaatctctggaacacgagggcaaaccgctgatataaacgtgcttactaatgtacaaacattattagagcaaaataatttacctatcaaatcaattattttggaaaacggctcaattttagctcgtttcaacaatacagatgatcaacttttagctaaagataaaattattgaacaacttggtaataattattccgttgcacttaaccttgcacccgccacaccaaaatggttaaccaatattggcggtagaccgatgaaatgggggttagacctacggggaggtgttcgtttcttaatggaagtggatatgcacactgcattggataaacgccaagaacaattacaagacagcttacgtaccgaattacgcaaagaaaaatatcaatatacgtctattcgtaatggagaaaattttacaactctcattaccttagctaaaccggaacaactttccgatgtacaacgtttcttgcgtaaacaacatcaaaatctgaacgttaatgccatttctgaaaacacactaagtttagaattatcagagaacgctctaagagaaattcgtgatcatgctattgaacaaaacttaagtattttacgtcgtcgtgtagaagaattgggtgttgctgaacctgttattcagcgtcaaggggctgagcgtattgtagtggaattacccggtgtacaggatacagctcgggcaaaagaaattctaggtgcaacagcaacgctggaattccgtttagtaaatcaaaatgcaaatttagatgtcgctcttaaaggtatggtgccttctgattcggaagtgaaatatgatcgcaatggtagtcctattgtgttatatcgacgagctgtattaggcggtgagcatattactaatgcaagttcaggcatagatcaaaataccggttctcctcaggtttcggttactttagattctgaaggtggtgaaattatgtcacaaactaccaaacttaatctaaagaaaccaatggcaactctatatgtagaatataaagacagtggtaaaaaagacgaacatggtaaaactattttagctaaacatgaagaagttattaatgttgcgacaatccaaggtcgtttcggttcacaattccaaattaccggcatcaatagccctgctgaagcacaaaacctatcggtattactacgttcaggtgctttaactgcaccaattcaaattattgaagagagaacggtaggcccatctttgggggctcaaaatgttgaacaagggctgaaagcaggattatggggattagccattacgattatatttattctattttactataaactcttcggtttatttgccggcatagcccttattgccaatatgatacttcttgtaggtataatgtctttattacccggagcgactttaacaatgccgggtatcgcagggattgttttatctgtcggtatgtctgttgatgctaatgtattgatttttgaacgaataaaagaagaaattaataatggtcgcacaattcagcaagctattaatgaaggttatagcggtgcatttacgagtatttttgatgcgaacttaaccactattctaacatcagtcgtattatatgctgtaggtactggaccggttaaagggtttgctattacactctctttaggtgtagcgatttcaatgtttactgccattacaggaactcgttttcttgtaaacttaatctatggcggaaaacgtgttgaaaaattatcaatttaaggcaggtgaatagtgagtttatttacacgcaataaaaaagtgcatgaatataaaggggtcattttaccttttaaactaaccccttttatgaaataccgctactggggatatgctttctctatcattgtaactgcggtctgttttttctttatttttactaaaggattcaactggggactggattttaccggtggaacagtgatcgatacccatttttctcaaccagcagacctcaataaagtacgatctacattaaaagagaatggaatagaaagtgcgttggtacaaactacgggaagtgttcgagatgtcatgatcagattacctgtcgtagaaagtagtgctgaagtgggtaataaaattaaaactatcctcaatagtttggatgaaggtcttgaaattcatagtattgaatttgtaggtccgaatgttggtgaagaattaacacaaggtgcaatttacgcaacattagcaacattactgatgttattaggttatattgctttccgtttcgaatggcgtttaggtacaggagcagttattgcccttgctcatgatgttattgtcactttaggtgttttttcctacttccaaattgaaatggatcttaccttcgtggctgctatcctgtctgttgtaggatattcgcttaatgatagtatcgttgtttttgaccgagtgcgagaaaatttccgtaaaattcgccgtattgatactgttgaaattattgatatttcattgacccaaactttggcaaggacattaatgacatcaatcacaacattatttgtcgtaattgcactttttgctttcggtggaccaacaatccatagcttttcacttgcgttgttaatagggattgcttttggtacttattcaacgatttatattgcaattactctagctcttgatttagggctaaaacgtgaacatatgctaatccaaattgttgaaaaggaagagtttgaagaaggcttctaaactcatgttgtcgggcatttgcccgacatttagaaccaacaaatcaaaacactggaaactgtttaaaaaaataacaatgaaaaatgagtggtaggatttttcacaacaagagttgtttaacacgagtttttttggttcaaaacgttagtcatgtttttcttatgttattctcatcaaaaacctatctgtatcatcttaaggtcgaataaatcgaataagcaagcatagtaatcggtcaaaaagtgcctactgtcttgctttgaaaaaaaagattgtctttctcaatataacgtattgctatgtatagactctactacacgtttttttggtagacggtatgtattttaggcgtgaaaatttttagaagtatttggaggtaattctaaaatcttagttttggagagcaaacggaaaagacagaattattgaaattttaagtagcgattttggggattaacgaggtaactttttggtgctctgagcgagacttgaactcgcacgtcctacggacactaccccctcaagatagcgtgtctaccaattccaccaccagagcgtaatttgaatttaggtttttattgaggaatgtcgctgttttttgtgtcaggtgtcggtatgctttgttgtttttcctgaacttgctccgcaacttttgataaatcatcaaacttaccacttttaacattattgctatgtgaattgatattaccaatcaataaactgatagcaaaaaatgctgttgccaaaatggctgtcgtacgagataagaaattgcctgcacctgctgaaccaaaaactgttcctgaagcaccaccgccaaacgaagcccctgcattagcacctttaccttgttggattaagatgaaaccaatgaggacaatggcaataactaagtaagcgatcagtaaaacttggtacattatttcttctctctaaattcaaacatttctataaacaaaataacgtgcgaatactatctaatattggaaaccttcgcaagtggttttgataaaaattcggttaattgttttaatttcaggcaaaatttaaactgtgtttactcattttttttcaaatctgcttttttattctctttcgtttgaagtcctagtttccgcagtgcggaaaaattaaagtaacctaataattcaggtaaaagttcactgagcctttgcataaattgttgataggatccttgcctgcggctgatgctgtccagttgagcttcccaatgtgcggtcatatccggctgagttgcgatttctggtaaggcttgaatgagtgttctgcctgtttctgtactgtgaatattccgcccttttttatagatgaatcctcgcttaaataataattcaataatgcctgcccttgttgcttccgtacctaggccatctgtttcacgtaagatttttttcaattctttattttgtacaaaacgtgcgattcccgtcattgccgaaagtaaggttgcatcggtaaaaggttttggcggttgtgtttttttgctaattacatcacctttttcacaaaataattcatcaccttttttcacaataggaagcaaaggttcttgttgttcatcttcatcctcttttccccaaagttgtttccagcccgcaatttgtaaatttctcgcttgagcaataaaagttcccccagcaatatctaatgtaattttactttttcgatattcagcctcttgacaaaattgcattaagtattggcgagcaattaaatcatagatttgttgttcattttggcttaaagacacagttttattttttgccgttgggataatggcatgatgtgcttctacttttttatcgttccaacaacgatttttcagctcagtattaactatatcgggaatttctttatataaaatactgtgtgtggaaattgcacgtaaaatagtatgtcgtgcggaaaaatgttcttcaggcaaatagcgacaatcggaacgtgggtaagtgattaatttatgggtttcgtataatttttgacaaatatctaaaatttcttgtgcagacatggcataacgttttgccgcatctatttgtaatgcagaaagtgaataaggcaaaggggcggtttctttttctcttttatcaatatattctgtcaccgtcgctggttgtgcggtaatgcgttttacgacattttcggctaacgctttggataatactcgtccttcttcatcctgataatcttcacaggctttacttggttgccaaagtgcggtaaatgttgagggcgttttttcttttgttgcaataaaggcttgaacctcaaaaaaatctttcggttgaaaatgctcaatttctaaatcacgacgtacaattaatcccaagacaggtgtctgcactcggccaacggatagaacaccgttatagcctgattgacgaccacgaatagtgtaggctcgggtcatattaatgccatataaccaatctgctcttgaacgtgctaatgctgatgtagcaagggggataaaatttttgttaggctgtaatttttttattgctttttctaccgcacttggattgagatcgttaattagacaacgttgaatttcggctaattttgtagcaggcaacttggcataactgaaaacttcatcaactaataattgcccttctcgatccggatccccagcattaattataatgtctgcttgatgaattaatttaagtacaatgtccagctgactttttacttcttgtttgggaagtaatagccatttttgcggaataataggtaaatgttctaaacgccattgtttgaacattggattgtaaacatcaggagcagcttgttccaataaatgtcctacacaccaagttacataatcttgttcgccacatttgacaaagccttgtccacgttgatgcggtttaggcaatacgtcagcaatagctcgagcaaggctgggtttttccgctataaataatctcattagactactgattttagggattgatgaaagccgaatattctaacataaagtcaggctattccaaattcgctaaattttcgctaaaatgccttgcgttttttgattaacttagatggaagaaaattatgttcggaaaaggtggtttaggtaacttgatgaagcaagctcagcaaatgcaagagcggatgcaaaaaatgcaagaagaaattgcacaattagaagtaacaggcgaagccggagcgggtttaattaaggttacaatcaatggtgctcataactgtcgtcgtattgatattgatccttctttaatggaagacgataaagaaatgttagaagatcttattgcagcggcatttaacgatgcagtacgccgtgcagaagaaatgcaaaaagaaaaaatggcatccgttactgccggtatgtctttacctccgggatttaaaatgccgttttaaattaattcatatatgaccgggacgcaatgtttgcgtccgtttttttaataagataattcattatgcaaagcagtcctcttttagaaaatctgattgaacatttacgctgtttacccggcgttggtcctaaatccgcacagcgtatggcatatcatttattgcaacgtgatcgtagcggtggtatgaatttagctggtgctttaaccgaagcgatgtcgaaaattggtcattgtactcattgccgcacttttacggaagaagagagttgtgcaatttgtaataatccaagacgacaaaattcgggttttctttgtgttgtggaacagccttccgatattccagctattgagcaaacagggcaattttccgggcgatattttgtgttaatgggacatttatctcctttagatgggattggtccgaaagaaatcggtttggatttattgcaaaagcggttacaacatgaaagtttttatgaagttatcttagcaaccaatccaaccgttgaaggtgaggcaacagcgaattatattgcggaaatgtgttttcaacataatataaaggtcagccgtattgctcatggtatccctgtaggaggggaattggaaacagttgacggtacaactttaagtcattcacttattgggcgtcgtgaaattcaactataacatggttgacgtcttcccccgactttaggtggggaggatgtcaatccttattttattgttacacgtgcgaattttcgttttccgacttgataaactgcggtggaaggtgaaacaataagttttgcattgtcgactttttcaccattaattttgaccccaccttgctgcaccatacgaatagcctcagaagttgagccaacaagtccagcatcttttaataaattcgctaaaccgatttcgccggtaaaggtaaattccggcatgtcatcaggtattgcccctttttgaaaacgatcaataaattcttgttctgcagtatctgcatcatcagcactgtgaaagcgtgtaataatttcttttgcaagtaagattttgacatcacgtggattacgaccgttttcaacatccttttttaattgtgtaatttctgtgagcgggcggaatgacaacaggttataccaatcccacataagctcatcggaaattgacatgattttaccaaacatattacttggtgtttcggttacgccaatatagttaccgagagatttagacatttttttctcaccgtccaatccgactaataaaggcatagtaattgcaacttgaggtttttgtccgcaagatttttgtagctcacgccccattaataaattgaaggtttgatctgtaccgcctaactcgacatcggcttctaaatgtacggaatcatgaccttgtaaaaggggataaataaattcatgaatggcaatcggttgattattgttaaatcgttttttaaaatcatcacgttccaacattcttgcaacagtataattcgatgccaaacggatcattcctattgtacccaacttacctaaccaatctgaattgaatacaacttgtgttttttgtggatccaatattttgaaaatttgtgttttataagtttccgcattgcgtaacacatcttctcttgataaagggggacgagtagtattttttcctgaaggatcgcctactgttgcggtaaaatcgccgattagaaagattacttcatgaccaaagttctggaattggcgaagtttattaagtacaaccgtatgccctagatgaatatcgggtgccgttggatctgcacctaatttaatgcgtagcggacggttttctttgagtttttcaatgaaatcctgttctgaaaaaacatgatcaacaccacgtttcaattcggcaattacagtatttatattagtcattatgaatccttaatttgaataatattaataagttttttattttccttattatagggattattgattaaaagaaaagtccatagaatataaggttgtcgtaataattcatttttttctcggcgaccaaagtgcgaataaaaaaagcggtcaaaaagtatttccttttgaccacttatcttctattttaaagactagaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattgcaaatatttctcattcaaattttcacataaatcaagcgttaactcgttgggcaaggaaatctaatacctgctccttagcaattatttgtttttcacccgtacgacgatttttatattcaatttcgcctttttctaaatttttttcaccaataacaatcatatgaggaacacctatcaattccatatccgcaaacatcactccgggacgctcttttcgatcatcaaagataacatctacatttttattgagtaagctctgatacaattcttcagcaaaaatttgtacattttttgacttatacatattcattgggataattgccacagtgaacggtgcaatttcatcagaagaccaaataattcctttttcatcatggcactgctcaatagttgcagcaacaacacgacttactccgatgccgtagcaacccataatcatcgtttgtgggcgaccatcttcaccttgtacagttgctttcattgcctccgaatattttgtacctaattggaaaatatgcccaacttcaatacctcgcttaatctgtaaagtacctttgccatcaggacttggatcgccttctacaacattacgtaagtctgcaactttaggtagggcaacatcacgatcccagttaacattaaagtaatgtttgccatcaatgttcgcaccagtgctgaaatcgctcatgagtgccacggagcgatcaataatagccggaattggtaggttcacaggccctaacgatcctataccggcaccaatttttgtttttatttcgtcttcatttgcaaattctagaggatcggcgacttccggtaatttttgtgctttgacttcgtttaactcatgatctccacgtacaatcaatgcgataagaggttggtcttcatttgcaccttttacgatcagtgttttaactgttttttccacagataaattaaattgttcaactaagtcattaatagtttttgcatttggtgtatctactaactccatagttgcactcggtgcctggcgttgacctattgctacggcctccgccaattcaatattggctgcgtagtcggaattgcttgaaaaaacaatatcatcctcgccactttttgccagtacttgaaactcatgagatgcactgcctccaatagatcctgtatcagcttgtacggcacgaaaatctaatcctaaacgagtaaaaatattattgtaagttcgatacatgacatcataggtattttgtaaacattctttgctggtatggaaagaataggcatccttcatcaaaaattcacggccacgcattacgccgaaacgaggtcgcacttcatcacggaattttgtttgaatttgatataagttcaatggtaattgtttataagaactgacttcacgatgcaccaaatcggtaataacttcttcgtgagtaggccccaagacgaaatcacggttgccacgatctacaaaacgtaacagttctggaccatattgctcccagcgttgggactcttgccatagctctgccggttgaacaacaggcatttcaacttcaattgcaccgctcttattcatttcctcacgaacaatattttccacttttttcaaaacacgtaagccggtgggtaaccagttatataagccggatgccaaaggtcgtatcatacctgcccgtaacatcaactgatgacttactacttgagcatcatttggggtttcttttaatgttgataataaatatttactcgtacgcatttttgttcctatatttcatgatcttgaatgaaaaaattggtgatagtgtatcattgagtactattggaaaaaaagtaaaagggataagaaagtcatattttttagtcaagggaatagttatcctttccggtagcgacgtaatttgcgaagtcattatgactaaatccatgagaaagcatataacgccaaattttttgtttagccctagaatctaatttatcacgatagtaaggaaattttttatttaaaacctgtaatactatttcgttccaatcaatttcactttcttgctcaatttcgttaattagttctgctggaatgccttttagctgatacaattcctgtctaattcgctgtaaaccataaccacgttttgcacgataataaaggtaattttcagcaaaacgtttatcattttgccagtttttttgttgacagtgggtaagtgtttgagtaatttcttgctcagtaaaacgtttctcctgcattttgcaacgaagttcaaattcactatattcacgccgagcaagtaaaccaatcacataacttaatgcgagcgaagacatatatttattttcctttgtagttaaatgtagataaagagaatacggacggaagaaagtgcagtcattttaccgcactttctatgatgagagctaaatactcagtactaattaaaaatcactttcaacttcagatatgtttgattctgattcagcttcaagatccgctaatagtgctttttccggatttgctaataattctgaacgtaatttttgctctaaaatagcagcttgctcaggatgttcagctaaccatttcatcgcatttgttttcccttgaccaattttttcgccctcataggagaaccaagcaccggatttatttactaacttatgttttacgccaagttcaataagttcaccatttcttgaaataccctcaccgtataaaatttggaaatcaacttggcggaacggaggtgcgactttatttttaaccacttttacacgagtttcattaccaatgacttcatcaccatttttgatactgccaacacgacgaatatcaagacgaacagaagcgtagaattttaaagcattaccgcctgtggtagtttctggattaccaaaaacaacaccaattttcatgcgaatttggttgataaagacgaccaaacaatttgagtttttgatctgccccgttaatttgcgtaatgcttgtgacataagtcttgcttgtaaaccaacatgagtatcacccatttcaccttcaatttctgctttcggtgttaaagcggcaacagagtcaacaatcacaacgtctaccgcaccggaacgaacgagagcatcacagatttccagtgcttgctctccgttatccggttgagaaattaataactctttaacgtcaacacctaatttagccgcataaattggatcaagtgcgtgttctgcatcaataaatgcacaggttttacctgctttttgtgcttgtgcgataaccgatagtgttaatgtcgttttgcctgaggactcggggccaaaaatttcaacaatacgtcccattggtaagccgccgatacctaaagcaacatccaaactaagtgagccggttgaaattgcttcaatatccagtttttgggtttcccctaatttcataattgcacccttaccaaattgtttctcaatttgtcctagagcggcttcaagtgcttttgctttttcttctggggttgccatgttatacctcaaataaattatctatcagaatttatatataatattatactgtattcacatacagtgcaatttaaaattttatctttttagaaattttgcgatctcatcagcaaaaagagaaaattattctatattattaatcaaattttctaatgcttcttgcattgtgaaccatgaaatttctatatcttcaagtgcttttttaagctgaacctgttcatttaaaagtgcggtgagttttgctttattttctgtctgataaagcactgtatcggaaagaagtaattcaatttcttgtagtttttgttgatatatttgcattttgcgttcaatatcggcaatttcttttcgtaatggtgcactccgttgacgcagttcagcttcttttcttttttgttctttgcgatgattaccggtgttttcgttattattgatgattttctcattatgtttcggcgtgctattaatttcatttagccatttttgatagtcttctaaatcgcctgtaaattcctcaacttgtttatcatgaaccaaataaaattcttctactgtattacgcagtaaatggcgatcgtgggaaaccacgaccagtgaaccttgataatctattaatgcttctgtcaaggcttgacgcatatctaaatccaagtggttcgtcggttcgtccagcagtaataagtttgggcgttgccaaacaataatagctaaaaccaagcgagccttttcaccgccggaaaaagaagaaacagcttgagttactttatcaccatgaaaagcaaaactgcccaagtaatcacgtaattgttgttccgtttgttgtggagcaattttttgcatatgccagagtgcattttcttccgaacgtagcgtatccaattgatgctgtgcaaaataccctaattttacgccttttgctaattggacatgaccggaaagtgcggtcagttcccctgccaataatttaattaacgtagatttacccgccccatttttaccgagcaacccgatacgagatcctggtactaaattgagcttaattttttgtaaaatttccaccgtactttctccattgtcataacctgcactggctttttcaatggaaaccaagggattgggtaaagcgagcggttcacgaaatttaaaggtaaaaggattatctacataagcaggtgcaataagttccattcgttctaaggctttgactcgactttgtgcttgtttggctttagttgctttggctttaaagcgatcgatatatttttgtagatggtttattttttgttgctgttggcgataaagtgcggtttgttgtgctaattttgttgcacgttgcacttcaaaggaagaataattgccactgtattcatgcagtttatgttgttcaatatgaatgattttattcacaataggatcaagaaaatcacggtcatgtgaaattaaaatcaaggtgccttgatattgaattaaccaacgttctaaccaaatgacagcatctaagtctaaatggtttgtcggttcgtctaataagagtaaatcagagcgacaaagcagggcttgtgcaaggttaagacgcatacgccaaccgcccgagaaagatttaaccgttcttgttaaatcctcttgagaaaaccccaatccatgtaaaagagaagccgctctcgcttgaattgtccaagcatcaattgtgtctaattgtgcatgaatacgggcaatatcattgccatgattattttcggtagcagttgctaaggccttttgtaatttgcaatattcacgatcgcctttgataacataatctaacgcacttatttctaaggcgggtgtttcttgatttacccaagccattgcccagtgatttggaaaagttatatcaccttcttcagcactcatttcttttttgagtagtgcaaataaagaagatttaccacaaccattttttccgactaagccaactttttgaccggggttaatagtggcacaggtattttctaagagtaaggtatttccacgctttaaagttaaatttgtaaaaaggatcattagataaactcactattgattaataccgatatctccactcataaatcggaacataattagaggtgaaacctgatgagttgagcaaaggtgaagatcgtacatataacttgcaatgcttagatcgatcaaccgcaatatcgtttttagtctagtcgtgacgatctaaaaacgattgcttatattcgagttagtcgtcacgctaggaaagatgatttggttcgtaaagttcgaagtaaaaaactttacaaaatatccaataattccacttcaaataccaacgtgctgaacggtggaattgatgcaccggcaccacgttcaccataagccaaatgatgtggaatagttaatttccattttgaacctagcggcatcatagataatgcttcaatccaacctgcaattacgccacttactggaaattcggctggttgcccacgtttgactgaactatcaaatacagtgccatcaattaaagtccctgtataatggacacgaacttgatcttgacgagttggaattgccccactgccttctaccaacacttcatattgcaaaccagagtctgttacttttacactgtcttttttcgcattttcttcaaggtattttttaccttcttcttcaatttgcttaaattgtgcttgtgcaatttcgctggcttgttgctgtaattcctgtaacgctttagcaacttcgtttaattctaaagcgggcggattttgattcaatgcgtcataaatcccttttgcaacggcttcagctttaaccgctaatttgctatcgactaattgttgaccgatttgtaaaccgataccataactaccttgagctgaaacatcatctaaggcaacctgtgcaaaaaattgttttgtcattgttttccctttattgtcgttgaaaattatttcttataagccaatacttcgcctacacgtacaggcacaccaacgtctaaatggtttgccagttctaccttatccgcttggaatagattgatcactgttgaacctaactggaatgcccccatttcttgtcctttacgtaattgcaccgcactttcgtcgctataagtccactctttcacttcagtgctgcgtggtggattaattattcccgcccaaacagtactcatactggcggtaatagtcgcaccgactaaaatctgtaccatcgtgccaaattccgtatcaaaaacacagatcacacgctcattacgagctaataaattaggaatatgttcatttaaaaacggattgaccgaaaataaatcgccaggcacatagatcatcttacgtaaagtagcatcgcaaggcatatgcactcgatgataatctcgaggagaaagataaattgtggcaaattcaccatgttcaaattctttagccaattcagtatcgccagccagcagatctactaagctaaaactatgtccttttgcctgcaacaaagtttgttgctcaatatgtccacattgactaattcgcccgtccgcaggtaaacaaagtgcggtaggattttcatcaatttttctcgcatcagcttttaacggacgaataaaaaattcattaaaacttgcatagtccttaaattctgttttttccgcttcttgcatatttacacgatactttttggcaaaaagtttaataataaaatgcgttacacttccccatttttgttttgccagccagccagctgccaaagttaaataaagttgtggcatgacatattgaaaagcaattttcaaacgttgccaataagtcggttgttttttttcagcattatacataacaggtttccttgtaaaaattggacgaggattataacaagttattggtgtaatgtaaccagcagaagagttattgtttgtcgtagaggggcggttttaatctaaagttaataaatagacgttaattatgaattggttaagtcaagcctattattggtgtataatggattttaataaacagagagggagatataatatgtgtacgattatgcagaaagaagcgaatttttggcagtgatcgagcgtttaattaaatggaaactcaaagattaataacatagataagagaatcaattatgcatatcctgttgcaaaaatattataattatttacgcattgaacgacaactcagtccatatactctcataaattatcagcgtcagctggaaaaaattgtagtgattttacaacaaaacgatattcactcatggcaacaagttacaccaagtgttgttcgttttgtattagcacaaagtcgcaaagaaggattacatgaaagaagtttagcgttgcgtttatctgctttacgacaatttctaaattatttggttgtacaaggtgaattaaaagttaattcagccgttggtatttctgcacctaagcaaagtaaatatttaccgaaaaatatggatatggaacaggtgcaacaattattgactaatgaaagcaaagaacccatcgatcttcgtgataaagcgatgatggagttgatgtatagctcgggtttgcgtttatcagaattacaaagtttgaatttgaatagtattaatattcgctctcgtgaagtgcgtgtcatcgggaaaggaaataaagagcggattttaccctttggacgttatgcttctcaagctatccaacaatggctgaaagtgcggttgttatttaatccgaaagatgaggcgttgtttgtcagtcaattaggcaatcgtatttctcatcgttccattcaaaaacgtatggaaacttggggtattcgacaaagcttaaacggtcatctcaacccacataaattacgccattcttttgctacccatatgctggaaaacagctcggatctacgtgcggtacaagaattattaggacatagtaatttatccacaacccagatttatacccacttggattttcaacacttggcacaagtttacgacaaagcacaccctcgagccaaacgtaaaaaatagttggaagcaggcaaattcaaacgaaatattaccgcacttgatggacgttcaagcacaatttgacaggttaccttgctcaacaacaatgccaacattattagcttgtgctatcgctttaggtttacttaattttatttttacccaagaaatattaaattttactcttaattgctctgcaacttcgtaagctactcgctcaattaacaaaaatgggcgagattgaacataattcaatataaactcactcacttccgcataatttaagcaatattttacatcatctgtttgtgcagctcggcgacaatcccacgccatttcaatatcaaaaatgagcttttgcttgatttgctgttcccaatcataaacaccaatttgagcaagtgcggtcaatccttcaataaatattttgtctgtcattataactccgatgaacaaaattccattaggcttatactatcaagtttatgtacaatagacgaacgaaaattttctgttcctgcgatagggagttgatgatgagtttgtttgcgattatttatatgttattcacttatttgttagggtcaatttcgagtgatgttgtgatttgtcggtttaccgagcgaaacgatgctcgtgtaacaaactcaaatgtattacaaaaaggggggtatcggcttgttttggcagtttttctatgtgatgtcttaaagggtatgttgccggtttgggtaggctattatttagggttaacttactttgaattaggcatgatagcactcaccgcttgtttaggtcatatttttcctattttctttaaatttagtgggggaaaaggggtggcgaccgcatttggtgctatcgcccccatcgcttggggtgtcgccggctcaatgcttggtacttggcttttaatctttctctttagtggctatgttgcattaagtacggtcgtaactgcattaatattgcctttctatgtatggtggtttaaaccagaatttacttttcccgttgcattagtttgttgtttgttagtttatcgtcatcatgaaaatatccaacgtttatggcgaggacaagaagataaaatttggtctaaatttaaaaagtaacgttacatttgcttgcttaaaaatttaaatagaaatcttgggttaaggttttaaattctgtactgtattgattgttccgatcataaataaccaactgactttcctcacatttccgttcttctcggctaaaactaagtaataaacgctgtggagttttacctgctttagtgatgattttacattctctaatacaaaaaagaccgcactttttttgtaaactttttccttcttcaaatggcaaaatcaagtgaatttcacccgttaggtttaatagtttttcggcggcgtttagccaatccaagtggctttgtgttagggtatagcgagctagattgcgttgtttactggcacaatcaataccttgcttaaaataaggtggattcgccgtaatgacatcaaatttatgctcacaatcttgtgcaaaaacaataatatcttgttgaaaaatcttgattttatttgcccaaggactttgttggatattgtcttttgcttgcaaataagcctgcggatccaattcaactgcactaatgtgacaatgttcggaactacgttgagccaacattaacgcaattaatcctgtaccggtacctaaatcaagcaacgtatttgcttggtcgatatttgcccatgcacccaataaaatcccatcagtccccactttcattgcacatcgatcttgcttaatgtgaaattgtttaaacgtaaatccttgctttttygyyataaatatcctgaaatttgaccgcactttaaagacaaagtgcggtataatttgccacaaattttttttgaataccaattctttaatacggataaatatgacatcaacgcaatttgaagacttcgatcttgctcctcaattactaaaagcccttgtccacaaaggctattctcggccgacagtcattcaacttgaggccattcctgcgattatggaggcgaaagatgttttaggttccgcaccaacagggacaggaaaaacagcggcatttttgttacctgctattcagcatttattagattatccacgtcgtaaacccggacctcctcgaattttggttcttacaccaacacgtgagctggctttgcaagttgcgaaacaagcggaggaattggcacaatttacgcatttaagtattactactattaccggcggagtggcttatcaaaatcatggtgaagtgtttaataaaaaccaagatattgttgttgctacaccgggacgcttactgcaatatattaaagaagaaaactttgattgtagagccgttgaaatactcatttttgacgaggcggatcgtatgttgcaaatgggcttggggcaatatgcagaagaaattgcggcagaaactcgttggcgtcggcaaacattgttgttttccgctacgcttgaaggtgagttattaatggattttgcctctcgtttactgaaagatccggtgcaatttaattcagagccaagtcgtcgtgaacgtaaaaaaattaatcaatggtattatcatgcagatagcaatgaacataaaattaaactccttgcacgttttattgaaaatgaacaagtaagtcgtggtattgtatttgttcgtcgtcgtgaaaacgtgcgtgaattgtctgaaattttacgcaaacgtggtattcgtagcacttacttagaaggtgaaatggcacaaactcagcgtactaaggctattgataaactgaaaaatgatgtggttactgtgttagttgctaccgatgttgcagctcgtggcattgatattgatgatgtcagtcatgtcatgaattttgatttgccttataacgccgatacttatttgcatcgtgtcggacgtaccgcaagagcaggcaaaaaaggtaccgcagtatcttttgttgaagcacatgactataaattattaggcaaaataaaacgttataccggagagttgctaaaacctcgtatcatagagggcttagaaccgagaaccaatccacccaaagatggtgagataaaaacggtgagtaaaaagcaaaagaaccgagctaaaactaagttggaagaaaataaaaaagcggcacggaagaaaaaacaaaaacttcgccataaagacataaaaaacattggtaaacgtcgcaagccaagcgaaaaaatcgctgaataaagcggtaatatatcccctgcctttaaggggattatgttattgatagctcaaaggtataatcttcaattcactttcatcaacaggcaatctaaaccgttggttttcttctaattggttactcataatgacttgcaaatataaaataccgttaagattgaccgcacttaaaatacatcctattttacgccaagcatgttctaattgcatttcaatttcagtaccaatttctacaagtgcgacagttttggcttgcaataaatacatggcacgtttatttatccctcgatatttggctcgagctatagtttcttgtccaatataacaacctttttggaaagaaatagcttgttcgatttcttgtaaattcagtgcttgtggaataaattctccttgtccgattattgttaaaattggaaagccttgctgcatatccaagtaatcccaatattgtgtatcttgcgtatattcaaggctcattttctgttcccaacataaaatctggcgattacccaaatcaatacgaatttgtggtgaaatagcaccgcactctttcagatcctgagcaagcatgcccacaatagtccaatttttttcactaaaagtcacttgagaaaaaaccgcatatttttttaattgagctaagccatgattgagtaaatcttggcggattaagagataaaattgttgttctgcatgacgaattagacggaaaagagaattgactttacctttcggatcgcaatgtgcggttaatgtggattgaccgattgccaactttgttacatcacaggttaattgtccttgtaaaaatttttcggcatcaacgccttctacataaattaaaccatattgcttaagattaattaacatttttgtccttattcaagattttggatttgttcacgcatttgttcaattaagacctttaattcaaccgctgatgaggtaatatcggcgttaatagatttagacgcaagtgtattactttcacgattaagttcttgcatcataaaatcaagtttacgcccgacagccccgcctttgtgcaaaatagcgtatgtttcttttacatgtaattgcaaccgatccagctcttcagctatatcaatacgttgtgccaatagcaccatttcttgttcaatacgttgtgtatctgcttgtaattgaatttcatcaaaacgttgttgcaaacgatctcgttgccattgcaatatttccggcataaaagaccgcactttttgtgcctcaacggaaattgccataaggcgttgttcaattaatttttgaactttttctccctcacgagctcgtgttgcaataaactccacaagcaaatcatcaaaggcttgcaacaaatcttcgatgatactgtccaagtcctgttccggcgtttccactacaccggggtagcgtaaaatatccatcagattgatttcaccctctccggcttgtgcttttatatattgcaaagattgaataacctgtttggcgaacttttgattaagatttaagttgagtgcggtttgttttttagtgtcaatacgcaagctacattcgattttacctcgagccagtttttgccgtaatttttcacgcaaagtattttccaatcctcgaaattgctccggtaaacgaaaaaaggtttctaaataacgttgattgaccgagcgaatttcccatacggcatcaccccattcttttttaatttcaacacgagcaaaggcagtcatactgtaaatcatatttttatatcctcacttttatattaatttaccggtgttattgtactgttaaatttcttttatgtcagtttgcatgataaaattgcaaaaattttttaacttcattcaaaggaatatgtcatgcgtccaaatgcgagagcaatcaatcaaccccgtccaataaaaattactcgtcattacactaaacatgctgaaggttcggtattagttgaattcggtgaaactaaagtgatttgtacagcgacggttgaagatagtgtaccacgttttttaaaagggcaaggaaaaggttgggttactgcagaatatggtatgcttccacgctcaacccatagccgtatgcaacgtgaagcggctaagggtaaacaaggcggtagaacgatggaaattcaacgtttaattgcacgctcattacgtgctatggtagatttggaagctttaggtgagcgtgcaatcacattggactgcgatgttattcaagcggatggcggtacgagaacagcatcaatcacgggggcttgtgtagctttaattgatgcaattaattttttgctgcaaaacggtacgttgacaactaatccgataaagggattagttgccgccatttccgttggtattgtcaacggtgaaacggtgtgtgatttagaatatgtggaagatagcattgccgaaacagatatgaatgtggtgatgatggaagatggacgtatgattgaagtacaaggaacagcagaaggcgaaccgtttagccatgcagaacttcttaccctattagatttagccaaacaaggttgtgaacaactttttgtggcacaacgtgttgcattagcggaataaagatagtttgtgtaagataaaaaatctacaatatacatttttacaatgtaagaatatcgcaatgaaaatggtgtggaaatacaggggttaaaatgaattttcttggaaaaataatcggttttatttttgggtggcgttttggtggtttttttggtgctgttgtcggcctaattctaggacaccttgccgataagaaactgtatgaattaggaagtgtaaattccagcttttttaaaaataaactcactcgtcaatcgctctttatgcaaactacttttgccgtattaggacatttgaccaaagcaaagggtagggtgaccgaagatgatattgcccttgcaacaagcctaatgcagcaattaaatctggatgatgcaggcagacgtttagcacaagaagcatttaatcgtggtaagcaaactgattttcctctccgtcaagttattcgagagtttcgtttaggttgtggacaacgagcggatttgttgcgtatctttttgagtattcaagtcaaagctgcttttatggataatgaattgcaaggtgcggaaaaaagtgtcttacaaattgtagcagaagagctagggttatctcgtttccaatttgagcaaatacttgcgatggaattagccgctagacactttagtcgtggcggtttttatcaacaaagtcgtacttaccaacagggaagttatcatcaatatcaagagcaaggacaatatcaaaacagctatcatcaatcaggcccaacgttagatgatgcttacaaagtgcttggtgtatcaggaaatgataatcaacaaactgtaaaacgtgcttatcgtcgtttaatgaatgaaaatcatcctgataagttggtttctaaaggattacctcctgaaatgttggaaatggcaaaagaaaaagcccaacaaattcaagcggcgtatgatttaatttgtaaatcgaagggttggaaataacttaatgcgagtttttttagcacctatgcaaggtgtgcttgatccttttgtacgtcaactattaacagaggttaatcaatatgatctctgtatttctgaatttgttagagtagttgatcagcgtcttcccaacaaagttttttatcgtttatgccctgaacttcaccatcagggctttactttgtcaggtacgcctgttcgtgtacaacttttggggcaatatccgcaatggcttgctgaaaatgcccaaagagccgttgaattaggttctcagggcatagatttgaattgtggttgtccgtcgaaagctgtcaatggaagtaatggaggtgcttcattgttgaaacaaccggaactcatttaccaagcaacaaaagctattcgtcaagctgttccaatggaacagcctgttagcgtaaaagtgcggttgggttgggataatgttgatcaggtttttgaaattgctgatgcggtacagcaaggtggagcaacggaaataacgattcatggacgaactaaaagcgatggttatcgtgctgatcggattaattggtataaaattgctgaagtcagaaaaaaattacgaattccagttattgccaatggtgaaatttggcattggcaagatgggcaaaattgtttagccattactggttgccaagatttaatgatcggacgaggggctttaaatattcctaatttaagttatgtaataaaattcaatgcggaaaaattagattggcaacaaggtgttatgccgatgttgcataaatatgctcatgttgaaaatgaatttgacaaaggtttctatcatattgcaagaattaaacaatggctacaatacttgaaaaaagagtatcctcaagctggcacactttttgagcgaattaaaagctgtcaaagtgcggcggaattacggcataaaatacaataaaaatggcgtgtaatttacgttacacgccatttttcaaccaatgtatttattttacacgagaaacatattcacctgaacgggtatcaactttaatcacttcgccaatttgtacaaatagaggtactttcactaccgcacctgtacttaatgttgccggtttgcctccagttcccgctgtatcaccttttaagccaggatcggtttcaacaacttccaactcaacgaaattaggcggtgtaatcgttataggtgcaccattccataaggttacaatacaatctgcttgatccagcaaccatttttccgcatcacctaccgctttggcatcagcagagtattgttcaaaggtttcaggatgcataaaataccaaaacgcttcatctttataggagtaagtcaggtttaagtccattacatctgccgcttcaactgatgtaccagatttaaagttgacatccaatactttgcctgaaattaatttacggatacgggtgcgagtgaacgcttgccctttacctggtttaacaaattcattttcaataataacgcaaggctcaccgtcctgcataaattttagacctggtttaaaatcactggtagtatatgtagccatatcatcctcaaattaaaagagattgtttttaacaaatgcgtattctaacccaaaatagcataaatagagaagaagaaaattggactgattacctcgcaaaggcaatttccgatcctatagaattacttaattatttagagttaccgattgaatcgtttcagtatgacattgcggcacgtcaattatttccattgcgtgttcctttcccatttgttaaaaaaatggaaaaaggtaacccaaatgatccgctctttttacaagtgatggcttcacagcatgaatttttgccgatggcaggatttaccaaagatcctttggaagaacaacataacagtgttcccaatattttgcataaataccataaccggttgttattaatagtaaaaaacagttgtgccgtcaactgtcgttattgtttccgccgtcatttcccttatgcggaaaataaaggaaataaacaaagttgggtaaaatcgctggattatattgccgcacatgctgaaattgaagaagttattttttcggggggagatcctttgatggctaaagatcatgagttagcatggttaataaaagagcttgaaaatataccgcacttacataccttgcgtattcatactcgcttgccggttgttattccacaacgcattactgatgaactttgtcggatattgagtgaaagtcgttttcaaaaagtcattgttactcatattaatcaccccaatgaaattgatgaaatattagcctgtgcaatgaaaaaattaaaacatgcgaatgtaaccttacttaatcaatctgtggtgttaaaaaatatcaacgataatgcacacattttaaaaaaattaagtgataaattattcagtatcggcattcttccgtattatttacatttattagataaagttgagggagcaagtcatttttatcttgatgatgaaagtgcggccgctatttataaagaattacaacgcattagttcgggttatctcgtaccgaaacttgctcgtgaaattgctcatgagccgaataaaacgttgtattcggcataggaaaaagaatgaagatcctttaaaatacataaaattttaccgcactttatgtgcttctttaaacataactttctgactcatcaagggactatcatgacagctgaacaaaataaaatcgacacttctggacaagcttctatacaaaaagaattggagcttgatctggatcctatggagccgatacttccgaaaaaaaatcttgcatctaaacaaactttattggaaaaagccaaacgtattttcaagagagcggataagcaaaatagagttgataaagcagaagtgagtacacataaagaagtaatatccgctagtgatgatgaacaacgtccaataatcacggaaacacaagagcaacaaataagccaagcaatagacccgactatatctgaagtgcctgttaagacacaaaaagaactgaaaaaaccggaaaattggactatgttaggtgtgttaccgcctaaatatcgccgtatttttattgcattattagttgtcgtcattattttattaattatttcttggttaaaaccggatgataatatagagcaatattttgaacaatcaacaggcaatagtattccgacacaatttcagcctttagatcattctcaaccggttgaaccgagcattttagagcaactgaagaatcctcaaccaaaaagtgaaaatatcacacagaatgatcaggaaaaaaatatgcctgtacaagcgttgcaggtagaaaacgaaccccaaaatatagctataccgataaattcaccacctagtaaggcggacagtccagtagtggaaacaagcaagcgaccaagtattaaagttgaggaagcaacatctcaacctatagcaccaatggaagaagtgaaaattgttgagaaaaatgagccaaataaaaaggcagaaaaacaggtgaaagcagagcagaaaggcgtgcctgttgttgatgcgaaaccggctaatgtgaataaagtaacaaattcacagaaaaccgctctacaaaaaaatgcacagactaaaacccttgttattccgcaaggaacctcactgatgcaagtattccgcaacaataatttgaatattgccgatgttaatgcaatgacgaaagcaaagggagccggtaatacgctaagtagttttaaagcgggcgataaagtacaagtatctttaaataaccaagggcgtgttaatgaattgcgtctatccaatggtgctcgttttatccgccaaactgatggaagttatcaatttaaaaaataatgacattaagcaaaacggcgtaattttcgcttacgccgtttgattgtcgaactaacattttttctatttacaaccgctctttttctccaccgaattcacttagcaagttttccgttaatttggcaagaatgccggtcattaaaacaaagtctgcatcaaatcgttgtgcaaaatcttcttttgaaatatcgtcattttgttcacgaatttgatcggcaaattttaagcgttttaaactggcatcttcgttgagagtaaaacttaaatgttcttcccagttgagggataagtttgtgatatatttgccggaatttaacaatccgatcatttcttcactgtccaacacttgttgtttgcaacgaataacggcttgatcttggcttccttttaattccgcctcttccaatacagtcaaccattgaggtgagttttccttaacccaatttgtcatcaccaaacttggctcattagcaaatacaagtggcacaactggtaaagatcctaacgattttcttaataaagccaaacagtcttccgctcgtttagttgaggcggtatcaatgtaaataaggttattttccgtatcaatccacaacgcagtatgttggtttttactgaatgcacgaggcaataacgtagcgacaatatcatcttttaacgcttgtttttcgatttttttcagtttgcgattttctttttgctcaagttgttcaatccgttcttccagctcacgtttaatcacttgtgcaggcaaaatcttttcttctttgtgagcaactagcaagagttgttttccaacacaaaaagagagagattcactttcacgcaaaggattgctccaaccgaaccggctcatgtctgattgttggcagggagaatatgcacattgttgtaactgtgattgtaaattttctaccgaccaatcaagagatttagttaaacggtaaattaaggcatttttaaaccaaaacattgttcttcctcaaggtttttcatgtaaaataagcactattgtaacttattcgagatgaaaatatgcaacataaattgattagctttattggtggaggaaatatggcacaagccattgttttgggattattaaaacaaggctatcctgcacattacattcgtgtttgtgatccgaaccaatctcgccgtgatttatttattgcgcaaggtacgcaagtaagtagcaacaatgtcgaggcaatacaggatgcggatgtagttttacttgccgtgaaaccacaaattatggcggaagtttgtgtaccgttaagtgcggttgatttttcagataagttagtgatttccattgcggcggggatttctaccgtaagattgaccgcacttttacccagtgcgaaaaatattattcgtgttatgccaaatacgcctgcacttgtttcagcaggtatggcaggtttatttgcgacaccgcaggtttcggtaaacttaaaacagtttgcacaagatttattaagtgcgatgggggaaatttgttggcttgaacaagaacaagatatgcacgccgttactgccggttcaggaagtagtcccgcttatttctttttatttatggaagccatgcaacaggcattaattgaaatgaatttagatccgaaaactgctcgcttattagtgcaacaatcagcattaggtgcagcgaaaatggtgatcgaaaatccacaaatcgctttatcggagctaagggaaaatgttacttcaaaagggggaacaacagcttccgccttagcggtatttaatgaacaaaatgtgacgcaaataatcaaacaggcaatgctggcttgtgttaaacgttcacaagaaatggagagtttattttaaatgagagtttcaccattcagctggattgcaatttgtttgtttggctatttttttgcttacggcgtgtttgttccctattttcccgtgtggttaaaatcacagtcctataatgaaaccacaattgggttaattttagccggagcttacttttttcgtgcattgggcggaatttgggtttcctctttggttaaacgtccctcacaacttattagcggcttgcgttatttagcttgggcaacttgtgtcttgatgtttgtcgccggttttatggcaccgcacttttggctactttgtatcttaatcggactgttttcgatggcaagttccggaggattgccattaatggacacgctttctaccacttggcaacagcaacaaggtttagattacggtaaagcacgtatgatcggttctattgcctttgctgccggtgtggtgattttcggctatgtgatagaaatgattaatgcgacaaatattgtatggatgttgaccgcacttttattcgtttatgcaatagggcaaatggcaaatccaacttatccgccactcgatcatattgaatctacacaacaagaaaataatgaaacggaaaaaacggattttagctttatacaattattaaaaaacaaagttacactacgtttgcttattgcgatttcgcttattcatggttctcatgctgcctattattcttacagcgttttatattggcaagaagaacttcatattccgcttcaagttattgggggtctttgggcattaagtatcgtggcggaaattgtcctcttcttcttttcatcaaaatggtttcgacattggaaagtcagcacattattttatctttctgcgttaggtgcagtggtgcgttggggcggtttaagttttgccgataatttgggtattgttatctttatccaacttttacatagtatcacttttgcgaccagtcattatgccattatccgctatatttccacacaacctcatcaagcgatggctaaattacagggcttatataacagtttttccgcctgtattgcagtcggtttattagcgggactttccagtcttatttatccaatctcaccgttttatacattcttaactatgatgttgattgcggcactggcgatccctattattccgagaaatatcaatgcctttcgtcaaagtatcatcactcgagtgaaatcatgaaagacaacgcattaattgatctttttttaaatgaactttggttagaaaaaggattatccgagaataccgtgcaatcttatcgcttggatctgaccgcactttcgcaatggctggagcctcaggggttgagtttagaaacccttgatgtggtagatttacaaacattcttaggcgagcgtttgacacaaggttataaagcaacaagtactgctagaatgttaagtgcattacgcaaactttttcaatatttgtatcgagaaaaataccgttcggatgatccaagtgcggtgttaagttcacctaaattaccgagccgtttgcctaaatatctgacggaacaacaagtaacggacttactcaacacacccaatacagaaattccgttggaattaagagataaggcaatgttggaaatgttgtatgcaaccggattacgtgtaacggaattggtgagtttaagtcttgatagtaccaatatcaatcagggtgttgtgcgagttatcgggaaagggaagaaagaacgtattgtgccgatgggagaggaagcaaactattggcttcgtcaatttatcctatatggcagatcctttctcttggcagggcagagttccgatgttgtttttccaagccgtcggggaactcaaatgacacgccaaacgttttggcatcgggtaaaatattatgcaatattggctgaaattgatacttctgcactttctccccacgtcttacgtcatgcttttgctacgcatttagttaatcatggtgccgatttgcgtgtggtacaaatgttactgggacatagcgatttgtccactacacaaatttatacacatgtggctaaagagcggttaaaaattttacacgaaagatttcatccaagaggataaatttttttatatttttttgtacacctgtatcgtataatgctccgttagtttaaaaagacaaagttaaactatttaaaaaattcatttctttgatacataaggagtttttatgaaatacaaactatctttagcaattctgtcaatactgcccgcactttcccatgcgggggggggtaatttcaacttttacggcaaagcaggaatcgatttaacctctcgttttgaaacaatggttcttagaacagaacaaaataattacgtcccgagtattcctgcaagttcaagacaaaataccttctcgccaagtatcttttttgaaaccacctacactattttaccgcaaacagaaatcggtttgggactgggctatatcaaacgcaaaggcttcgatcattctgccagctggcattttaataaggatgctcaaaaaaaaacgtggacacaaacatcaggtctcacagacatcgaacaatatagaatttaccgttattcttccctaccaatttatctcatcttgaaacagaattatgcgtttaatgcaaacagcaaattttatctaaaagggaatataggttattcaatcaataaaatgcctaatacaaagtatgctcattattcaaatgagacaagccgagaaattcagcaaacacaaattggcgatcctatttataaaatgaaagcaaaaaacgggctgtatttagggttgggtatcgggattgaatataaatctttcttagcggaaattggttattaccatacccatgcaactgtcagttacaaaaacaaaaatacccaatatccacaatattcctacaacaacgatgccatacgtttaacccttggggtgaaattctagaaaatgaaaagcgactaactgcggttagttagtcgcttttatagaaaatttttatatttttttgtacacctgtatcgtataatgctccgttagtttaaaaagacaaagttaaactattttaaaaaatttatttctttgatacataaggagtttttatgaaatacaaactatctttagtgcttttgtcaatactgcccgcactttcccatgcgggggggggtaatttcaacttttacggcaaagcgggaatcgatttaacctctcgttttgaaaccatgcaactcagaacatatctgaacaatgacgtaccgagcattccagccagctcaagacaaaacaccttttcaccaagtatcttttttgaaaccacttacactattttaccgcaaacggaaatcggtctaggattaggctatatcaaacgaaaaggcttcgatcattctgccagttggcatgtacatactgatggagaatgggtgctaagtggggacaatactgctgttgagtactataaaataaatcgctattcttccctgccgatttattttacgctaaaacaaaattatgcctttaatgcaaacagcaaattttatctaaaaggggatataggttattcaattaataaaattactgacaccaaacataagaaatacacaaatattacaaataaatttgagttactaagtgaaaatctacgtaaaatgaaaacaagaaacgggctttatttaggtttagccattggacttgaatataaatcgttcttagcagaaatcgggtattatcatacccacgctgcggttaattataaaactaaaccttacaaaagcaaagcagaaggctactatgcttggcattcttacaacaacgatgctatacgtttaacccttgggtttaaattctaaaaaataaaaaagtgattaattgatctgcacctaaaagttggactaaacaaccaacgatcagtgtgcagatttttatgacaaaagataacccatctttcaaatagcaaatcatcgttgagttttatttatcaaaaaagcagtgatcgctcactgcttttttatggtcgttcaactaggttaccaagcccagccgatacccacaccgccaccgaagtcgccgacagagttgctatttccgtgtaatttcaacagaaccttaccgttatcactcacacgagaatagcctaaagcgaccgcactttgacctttatacgtaccggcagagactgaaagcactgatttccccggaatcgaaatcgtaggcaatgccgctgccgcattcgaaccggcaattcctgctcgagattctttactaaatgcatcaaatctattttcaagctggttgaattttttgtcagtatgtgtttgtaaggcatcgacatatcctttgttaaccacggcattcggtgaagagttcggcrttaaatccggcactctgatttctcctttcgccccgtcaatctcaatrcgytgwccttgcggrttggtcaaggttaatccgctygrsgtsarmgtygyacygtgcttaccgwcmgtyaatytyackccrtckrmmycrtawtgtgccgatttgccgtctttatgrrttacccgtaatccgttgccgtcaagacgggatttattcccctctgcggtttctttggtttcaaaagasgtcatrtttttcaacktrtcggacagtttgacwtccagtcccgtctcggaggcgtccactttaatattgccckccgccgtggtcrcactgttaaactcrccctcgcctttgatggtcaatttctcgcctaaatttttatggacaggcacgccgtcattgccctcaaaatttaagcccgcttgtcctaaagcctkcacgtcttgaagattggcagcacgcttcacatcaatgctggaatcatctgacaaaaacttattgactgcgtcatcttttgtggctaatgcggtttgataggcgtcttgcttcgcttttaatatgccttgtgccgattcaacctcttttttcgccttatccaatttcgagttaatgtcggctaatgttgatttttcgccctcgatcttagctttggctttctctttcgccgctttttcctccggtgtagtttccggcatgaaagacaatgcggtttcaagagcgtcaatggcgtcctgtttcgcctcttttgctgtttgtagcgtcaacatatcgtctacttttttcgccaccgcctgtgcttcggttttcactgcttcgcctgcctttttcacgttttcggcatgctctttcgctttgtcggcatcaatacccaaaccgcttgccacgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggatctccaacaaatactattcttcttctatttgtcgcattaccaacagataaagcattgtttacagctattgatctatctcctaatactattgcattatttatttcttcatctgctttgatatgagatcctaacaatatatttnnnnnnnnnnnnnnnnnnnnnnnnnnnnnnnnnnnnnnnnnnnnnnnnnnnnnnnnnnnnnnnnnnnnnnnnnnnnnnaatacaaaagaataatgaccttctactttattttctttacctacagatattgaactaagacctaatacatcagaatcttgtcctattgatattgcaccttgattttttgcgaatgaattataacccaatgctatcgaaccctcattttgcgataccgcattatgtcctatagaaattgaccctgttcctattgcttgtgtttttgcagaatcagaaagtttaacggatttatcccctgtgcctttcagatagtcgactaaggctttggcttgtactaattcgcttgtaccctctgtttcatcttctttaagattgattttatcaatgccgatattagaaccaaaaatcgctttatctttaacatttgcaccatctatttctaaataatactcttctaaatcccctactagagtatctctttgagtatattttttaagctcttccgccacagctttagatgttacaactttgtcactatctgggttaaaagtcgtttctttatttaacgttaacgtaagtgctttttctgtagcacttgctgtagccattatatctacaccagttccatcacctttgattgtgatagtctctccaagtgcaacgttggctgtaccgctatttcctgaaaatgttaatcctttaccaataatcgctttagccacatcagataagtcttttacgtttatggcattattttgaacagtatctatagacgttccagttaatacattttcaatattagttgctacattatttgcagtcgaatctcctaaaccacttgcaacacctgaaattttaactttatcactgtctgattttgtgaatgttaatgtcgctccactttcagggcttaactcaatttgctttttaccattacttgtaattttaagacttccagcatcagttcctgcagtgatggtcgcctcattctcttttaattcaagttttgatttatcatgagctaattctacagttgctttatcagcattaagtgtcaatttggatttactgtctttactactaatttcagaaacgccactgaatttatcttctgttaatgttacagttttacctgaatttccggctgtgaaaacgatagattttccacttccattagttccattgtttaatgaaattttcacatcgtcaccattagcaactgattttatgccggttaaagcatcttttaatgtgatacttactgtttgcttattcttatcaactttagtgtcaatatttttgctatctcctgcaattgttaattcattatgctctttatctaatgtatatacttctttattatccttactattatcacccttaaccgtaaaattagctgcgactttttctaatcttttgtctaaatattttttgttgacagcatagttatcataagtatttttcttaggattagctggctcgtcttcgggaatatcattttcaattaatacatttttaaaagtaggtgattcttttattcctattaataattgcttactatcttttagatatgctgttttaatattatcaggaacgtatcctccttcttgagtagtagttggtttatctayagctcccgctttaatgattaatttatcacctaaataatgcgttcctttttcagtatcgccatctccgcttccaaaaataaagcccttattaattttatctatatttgcctctattgccgctttaaatgttttttcttcttttagtatctgtccattttgttcagttccatttttaaatttattaaattgtgattttttaaatgtaaatttaccgttatcaacttccgcacctaatacatttgttgcaaagttctttaattgtaaaaagttaacagcatgattgtcattcgttggtgcttcagtaattgttacactcttaaattcaggatcgtcttttaagccgatagtgaatttagcaacggaattgtttgttttgccttgttcaaatttcgtttctaaatttttaccgacatattttgttttactgtttgattcaatatctccatttacaatttcaatcgtagatcctaaataaaacggtgtatctttatttggatggtcaggagtaccatcactaaacttatacccagagttaatcgctgcaatggtttccgttaaagcagccttaaaggtatcttgtgatcccttgtctccagcttcaacataattcacagcagtaaaatcatgttttttaaattttgtttgactatctttttgatattctaatcccaatgcctcttttgcactatttaactgtgctcccgtaatcgcctgatcggaagtcgctgaaatttcgccatcagccaaatgtccaaattttattgtttcccctatgtcagcagttgtttttccatcagcaaatgtttgagttttttcatcaaatcctttagcaccaacgaagactttgttcttgtcaattttgcctaatttttttaaaggttcgccatttcttgtatctactctataaaattcaccgtcatctgatgctttcattaatttaactattttgttattgttatccactgtataataaacaaccaacccctctttttttacatattctaatgtttttagctgaccaacagtcgccacatcagaatccaacgctcccggtgcaacatttattattcttctaagtcccactgcctctgtgtttgtaccttcgctaaccttccaaccaccaacagatatcaccccataagaggcatcattttttatttcgtaagttgaacccgcagctttataagcatctaatttagaagctggttctcccgataatttaggcgtaaatttgtcgcttgcatctgctttgttatcataaaaataattagttgttgatttatatcctaatgcaacagaattagacaaattggcttcagcttcattacctaatgccaacgcacctgtagcatctttacctacacctgcttctataccaagtgcgatacctttttccgcttgagattgtgctttataaccgatagcaactgaatattgtttacctgaatacgtattattccctaacgcaattgaggcttsrccaatggcacgtgtraaactycckatygcaaakgcrtytttttcttttgcaaatgaaaatcttccgattgcaatcgcactatcyycyttggcrtaagcrtatcktccwattgttagygtattgtctccyaatgcgacygaatacgaacctatcgctattccaccttgattatatccgagtgaayctcttgattgtttcgcttttaattcttcygttccmtcttgtttggtmgttttaggtttgattaatykmrmatwwknttgtatatctkyygtatttcctwwytcatawaattyttcaaaatcaaattttgcaccatatgaatttttactatccgttaaagtaaagccattattattttgaagtccaycwttattraamttmtyatccatctctatatttgcyaatgcataatttccaattgccartgaacctctacckccygcatacgaatcggaaccgtataccatagcaccrtcattaattgcttgtacrttagtacctaccccaacygttctatctgcatayacatacgatttgtttccaagaactaatgattctttaccaaatgcgattgtatctgaaccaattgctgttgaataatctttaaaggcaatggcaaacgttccgattgcagtcgtrtaatcaccrtatgcaatacttcttgccccaacygctattgmatttttccccckagcccawgtgtgagttyttytattatcgtatttaactccatttaattttttttctttctctattttgtttccaccgtccttatctaaatatttttcataggcgacatttactttagaatcatattcttgttttcgtagataatcgtctttcttttttattttttcaatttcacctctttctgtaactttatcatatgaatgaccattgtttttataaaaaacctcttcaccattatcatttttgataagataataactactccatgttttaccatcgtctcttacaaaatactctccatttaatactagagtattaccatcttttcctactaactccccwttrccattaacataytcattttttyyrwcacyatwaatwycyaayaaaaatctaaaatcaactgccggatattcmtctgtatagttaaarttttgtgcattatytagaaacaatctaaagatgtcttttggtagttttttttgttttgyatctgcayttccgataccgtctgatccaatcgcaattgaagaatctccccaagcaactgtatcattccctaatgatgtcgccccygctcctctcgcaaargttctatatccaaccgcwgttccttgtgcrttagcattatcaatatttttayctttagtgttttctccaacaatcgctttatatcctattgaggttgcaccaattccaccacccacagcacgagaacctataatgactgcatatttggcktsttsattttyaatryyagattcagcacctgctttatttgatttgtctgctaataatattagttcttgatgttkwtctttaatrtttttattygctccrtcataccaaatacttgtattgtagttagatttaccgtgttctctggatgtattattatctatccacacatctgctccatacgctacactcgacacccccgacatcgccaacgccagcggcaggaccttaaacgcccctaacacaccgccgaaaaacccaccgcacttcggcttttctcccgaactgctcgctatttggcgattgcttgccaactcggaaacggctttacattgacctgttgttacatcgtattttgttttgaagattttgttcatatatctattctctttaaaaatggatttttaaattaatgatttctttcgttgattgattgtttagtaaactttgtaggaattggttataagcctaaacaggaaatgccttgctttttaaggcacagcagaaaaaggcgaatgatatcttcactaagggttttaaaagggtagattggggtatgacgagaagttaaaaactttttaaaatttattttgcaaggtttataaaaaggcgttagcctaggctgtaggctgtaggctgtaggctgtaggctgtcatttttctattctatttttgtttgtcaagtaaaaatccggattattctatctcaaaatttttatggaaaaaacaattttcttacgtttttattctaattcagagggtgatttttaattacgttgtttgatgtcaaagcgaaatttaatgaaaatgaccgcacttttgggcacaacaaaaatccctattgggtgagacttcaatagggattggctgtttttaaattatggcaggaatactattttttccaattatattcaggattgataatatcttctatttcatgccaataagcagttaatacgacattgccataagcataagcccgaagtgcatagggcggataaacaaagtttattccttcattattgaagtaaaattgttctgaaatgttgaaatcttcttttgtgatcataccaatatagtcatcattcgcttcttgcattagattggtataaaagctccaaagtacttctttcagcttggtttgttggtcttgctgaatgatgtcgtttacttcaagtattttctttttatgactatcaatattctgatatagggttacatttatgccgtgagcaccaccggtataagtatcaatatcgttactgaacgtaatgatattattgcgttgccctagataatttgatgttagatggaatgatgcacctaatacacggtcttcttttgcactttgaacgaattcatcatgaatttgttgaaatttttgtacaagatcttgttttgtcggcgtgtcttttttcatgctatcttcaccgcccactaaggtataagcatgtttgagcaataactgatcaagccattttataccggtttcggataactcaccacgaacttcaatttgtgcattgtcagtagtatattcatcggaatgcgggtaatttacggtttttacttgatcaaagataacatttttcttgacttgtaaagttggaacgtcttgttcctgacaagctgccaatagaacagttgtcataagagagaagaataaaaagatttttttcatatgattgccaaagtttagtggagtaagaaagtctttattataagttggcagagtatgaatgtaaatttttcttttgggtaagaataaatcgatatattaagtcgctattcttccgtataatacgggttttatttagatagaacgcaaggatattttatgaagcaaactactcaatcgatgaatatagtcgatatgttgatcgttacagtgatcttttttggcatgccgatttatacttctctgtcgcaatttttcttattgcaagaaggtgcggtcgcaattacagacacgttgacatttacggatcaggataatatttgggcaattttgatagaacttatctcattagcgattgctgcggtgtatttaaagataagacgctttgattttacgcagcttaccttttcttttaacgctaaagcgattgtgctgaccgcagggataattttgattgccggcagtctcagcgaactttatttctatttggcagctccctttcaagatgccggtgcatatctcacctcggctgaggttgcacttacagatacaacatcgaccttatctttttacctcgtcctcttttcattgctcaacggtttttttgaagaagtcttttttctcggcttgatatttgcagtaaataaaaaagccttgccttatgcgattgtgttcagtttggtcatccgttttttgtttcatacctatcaaggtatgttttatgcagtaaacgtattgttattcggtatcgtattgctaatacttcgctctaaaatcaaaaatttattaccgtttacgttagcacatgggttctttgatatttttggattgggattgttacccattattgatattgtcgaaaaaattatcaaataaaaaggcgtattaaatacgcctaaataaacaatcggataaccgttagaaacggtagttaagatttaaaccgtacaaattggcacgtgccgttgattgataatccgcacttatattaacgagtttaatctcttttccaatattttgtgtttcgctaaattgctgttttttacctcgtaaatgagcaaaacctacgtcaacagaaagatttggcgtaaagttataggttgcccccaagctataccaagtgcggtcggtatcggggattgaagcacttgggtggtcggctgactcatcataagcaatacctgcacgcagggttaatttatcattcacattataagtcgcccctagagctacacgtgaactgtcatgaaatttttcatctttatggaaagcgaccttgccgttatcataagtggcatgtaaactttgtaaacggctccatttagtatatttatagctgtagtgcatggcgaatttttccgttaattggtggaaaccggaaatttcgaaataatccggcaaatgtagcgttaacccacctttctctttaacaggactaatttttcctgcttcaaattgataactcaacgcatcatcatctttaaaattaatatctactttagaatgataggcaataccgatacggttaccttgattaaattcatagactgccccgatattccaaccaaatccccatgcattattatcttgtaattgtgttaaggtggtatccgcattgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacacctgcttgtcgttcaattttcgctttggcataaaccgcattcaacccagcaccgatgcttaatcctttgctgatacggtatgaaccgcttaaatttaagttaatggaattcagtgcggtggttccacccaaaacaccggcatcataatcctttttatatttactttgtaacccaaagttcacattcatgcccgcgccgacagcaaatttatcattaataggtgcgacgaagtacatattgggaataactgcacttggcacaatgtttttctgatccccttttccagtttcaattccgtgaattctccccgcattaacattaacctcaccatttatattaattctagattgaacgtataccccccccattgagaattgtttcgttttaaacaaactcattaacgctgggttggttgccacaacagcggcattatcagcaatcgctgcctcacccgcataagctcgtcctaaaccggaactggacacctcagcaatttggaacgccgccgcattaacgtaacttgccgataatgccaatgctgaagcaatgaaagatttagtaaaaagtgattgtttattgctattcattttttatttaatacctctatatatggtgaagttaaatttcccgaattctaaagtaagagtagtatcgggacaaatgaatttactgatttgttcagtggtcataccaggcggaaatctttcatttactaaagtttataagaagaatttagctgtggcagacaataaatcagtgagttctagttcctcattttgtagaatgttaaaaactttttattgtgttttttgggggaagttataaagattgggtaaaaaattgtataattctttataaataacgcaatataatgatttaatgctaaggaaataggaatgacattgtacaaaatattggtgaatagtatcgctatgatttgttttagcgtttcccttgtagcacaagcaaaaataacggtttttgccgctgcttctatggcaaatgtgttagaagaaattaaatctgaatacatcaaagtaaatcctcagcaggaaattgatttttcctttgcttcttcttctgtcttagcacggcaaattagtcagggagcacctgcacagttgtttatttctgcggatcaaaaatggatggattttttagcggaaaagggggcaattgtgacagaaagtcgtcgtgatttggttggtaacagattggtgatgattgcacctcaaaatagtttgattacctctgttgatttgcctaacgctcaatggcattctcatttgaataatacttatcttgcagtaggtgatcctgagcatgtaccggcaggaaaatatgcaaaagcggcatttatctttttggggcaatggcatgatttagaaactaaattagctcgtgcaaataatgtgcgtgcagctttagcattagttgaaagaggggaaagtccgttgggtgtggtttatgcaacagatgcggcggcaagtaaaaaggtcaaaacagtggcgatttttcctgaaaatacgcaccccgcgattgaatatcctatcgctattgtgaacgggcaagataatgaagaaagccgcaagtttttggcttatttgcggtcagaaagtgcggtcaaaatttttcaacaattcggtttttcagtgaaataatttttatgttagatgtgataatcgattatctacgtttatctcaatctgaaatcaatgcaatctctttgagtgttagagtggcattggtttcaatttcggtgagcttaccttttgctattgctgtcgcatggttgcttgcacgcaaagatttttggggtaagtcgattattaacggtcttattcatttaccgcttgttttacctcccgttgtaattgggtatttattattaattgctatggggcgtaacggtattatcggtcgctatttactacagtggtttgattttagttttggctttagttggtacggtgcggcgttagcttctggaatcgttgcatttccgttgcaggttcgtgctattcgtttggcaattgaaaatattgattttcggctggaacaggcggcacaaacgttaggtgcttcttcattgcggatattttttactattacgttaccgctttcattaccggggattttatcaggaatgattttgggttttgcacgatctttaggtgaattcggtgcaaccattacttttgtatctaatattcctcaagtgacccaaactattccgctggcgatgttttcttttattgaaacaccgggtgcggaatattcggcatttagactttgtgttatcgccattattattgcattgatctctttgtcaatttctgaatggctggcgaaacgaatgcaacaaaaattggggtaaagatacttgtaattataagcctgtgccgagtgatgctttagcggtaatttttgattatttattttacaatcgttcatcatttcctgtatgaggctttatcgtgtcgttatttctatgtgctgaagaaagattagtgcaatgtgcaacttctttaattgaacagtttcctgagcaatacaacactacactttttcaacaaattcaaaaagataaacataatcaaaaaacgcaactcgggcaattaggttatggattatatttatcagattttgtgtttgaaactttgcaaaaacaaccgcactttctcaaacaatgttggcatcaactccctactttagctgattgcgatcgatatttcgttcgcttacaggaaatactgataaataccgaaacggaagaacaactgtaccgcaagttacgtctatttcgtcatcgtgagatggcaaaacttagcctttgtcaaagtttaaatttagctacagtagacgaaatttttattcggctttctcaattagctgaaagtttgatcattgccgcaagagattggctgtatgaaaaaatttgcacagaattggggacgccaacggatacacaaggcaatcctcaacaattatatattttgggtatgggtaaattgggtggatgtgagttgaatttttcttcagatgttgatttgattttcacttatccgacaaatcagggggaaacacggggaggacggcgtagtattgaaaatggtgtatttttcacaagattgggacaacgcttaattcgtgctttagatgaatatactgttgacggttttgtatatcgaacagatatgcgtttacgtcctttcggtgaaagcggtgcattggcattaagttttaatgcgatggagcaatattatcaagatcaaggtcgagattgggaacgctatgctatgataaaagctcggattttgggagcaaatatgcaagatccgaatgtaaaaatattacagcaattattacgctcttttgtttatcgccgctatattgattttagtgtgattcaatctttacgtgatatgaaaaataaaattgctggtgaggttcgccgtcgaggattgttggacaatataaaattgggtgccggcggtattcgagaaattgaatttattgtgcaggtttttcagcttattcgtggcggacgtgaaattattttacaacaaccatcgctgcttcatcttttacctgcactggaaaaattgggtttaattgataccgagcaaagcacaaatttatatcatgcctatttatttttacgcagagtggaaaatattttacaagctattgatgataaacaaacgcaaacgttgccaagtgcggatatcgatcgtgaacgtttacttcttgctacaaaaaattttacctattttccgctattgacggaagctacacaaaaagaaaccgcacttgctcaatatcctattgaaaattggcaacaatttttacaggtattgcatgaacatcagcaaaaagtgcggttcgtttttcgaaatttaattggcgaagatgacgatgaggaagaaaaaaatattgctgatgatctgtggcacgactttctcaatgctgagatcaatgagcaagaaattaaagtcatattgcaggaaaatcaaatagatgagcaatattttgatgaaattattgaaaaattgacacagtttaaactggatttatctcgtcgatcagtgggagaacgtggtcgcagagtattaacgcaattaatgccaatgttgttccgtcaagtatttcgatacaaacattctcagcaacttttacctagagtcttgaaaattctggataaaattatcacgcgtactacttatcttgaattattggtagaaaatccacaagccttaactcagcttcttaaattatgtgcacaatcaaaaatgattgctgaacaagttgcaaaatatcccattttacttgatgaattattagatcctaatgcactgttaaatcctacggattttcatcaatattcatctgaattacgccgctatttacttcgtttaccggcagacgatgaagaacaaattattaatgggttacgccaatttaaacaaaccgccttattacgtgttgcggcagcggatattttaggggcattacctgttatgaacgttagtgatcaccttacctatttagccgaagcaattatcgaaaatgttgtcaacctcgcttggcaacaagtcagtctaagatttggtacacctgaatatttgaaggaaaatcaaaaagggtttttggttattggttacggtaaattgggcggcattgagcttggttataaatcagacttggatcttgtttttctctatgacggaagtcaaacaggacaaactatcggcggtaaaaaatccattgatagcaatcagttttatctgaaattggtacaaaaaataattagtatttttagtatgaataccagtgcaggaatactttacgacatagacattcgtttacgtcctgccggtgatgcagggttattggggtgttccttaaatgcctttgaaaattaccaactgaatgaagcgtggacttgggaaaaacaggctttagttcgttgtagggcggtatacggcgatattgatttatgtgaacgctttgaaaaaattcgttgtaatgtgctttcagctccaagaaatgtggaacagctgaagcaagatatacgagagatgcgtcaaaaaatgtatcatcatctctctaaacataaaacggacgaatttaatattaagactgatttgggcggtatcacagatattgagtttattgcacaatacttagttttagcttatgctccccaacattcagcattaacacgttggtctgataatgtcaggatatttgactgtatggctgaaagtgcggtgatttcacaagaagtttccacaaagctaaaaaaatgctatgtaaatttacgaaaccaaattcatcatttaaatttattaggtcaagaaccgattattaatgcacaactatttagcaaggaaagaacgtttattctcaatacatggaaaagtttattggaatgaatgaacttataattgccctaaaatcagcatatgataagaaattatttatcatttgtattttctttgttatgctatgcagacctttaacttacattaacaaatgagaaataaacgatgaaattaaataaatcacttttggtcggcacattagtcgcctcaactgtattattagcagcttgtaatgaaaaaaataaagcggaaacaacgccaactgaaccggttacagttgcagaaactcaagctcaacctgacgttcaaggaaaaactgaaacaacytcrwctgaaycaaccgcarytgraaayacacaayctgawkctcaagaaaaagttgtttcagaaaaaagtgagacagttgaacaagaaattcttaatcagtttaacaatacagttacgatccaattggtggggtatcagagtgaaaaaatagagggtgaagatactttatctttcgtttataacgttaagaataaaggtgataaagcaatcaaagaacttcagtggtataaccttgttttctttaattcgactctggtagagcctctttcaatagcctattcttttgaggatacgcttgctccggaaggcgagggcgaaataaaattaacaaaattagctaaaacttatgctgaagagattcgtgcagatatactaaaaccggaagctaatcttcaatttagcccaataattgcaggtcgaattatttttgaagacggtacgcaattagttgtaactacagatgaagagcttactcaatctttacagcaaattttaacgcaataatttttaaaaataattattcaacgcattagttatctatccgctcttacaagctataatatttataaataactacaaaaagttatcaataagattttatagattggtaagatcggttatgtttccgcatcgaaatctactgcccattattggcgaaaccgaaagaaattcgtcgtaaaaagcgtgcagagcaacaagaaaaagaagtgtgaagaaaaaaagctgagaatttgctaaaaatcagctcaacaaaccgcactttaataataaaaatttctgcgagaaatcatgtaaaaaaaataacaccctcttaacaagaagagggtgaataatcaatttaccattggtaccctatagaaactgaacctgccattttgccttgagaatttctatttccttgaaatttaagcataatcttaccgttatcactcatacgagaataaccaatcgccattgcgttttctccgccataacctgctgcagaaatggctaacatagatttacccggcatagagactgatgtcaaccctgccgccgcatttgcccccgcaattcctgcacgtaaatttcggtcagtattattcaattgtgtacgcaattcattatttttaccatccacatagtttttatttaccaccgcacttccagtggttgttggtttaatatccggcacggtaataatacctttttcaccatcgattttaatttcaccacctacacctttaacagttaagccttttgcaccataggtagcagtagcagtagcagtcttatctgttacagttaagctatcgctatttaacgtcgatttcttaccgctctcctctttggtttcaaaggctttcatatttttcaaagtatcggacagttttatttctaaaccatcattagttttattggtttctaccttgatattaccagcggcactactaaatgaacttgcagtttgaccgttttgaatttcctcttcccctttaataattaaggtatcgctcagttttctatgaacaatcttatcattaccactctcattcccagcaaaactcaaccctgcttgtgcaaccgcttttaaatcagcgagattggcggctttgtgtagttcatcttttgtcatttgttgcccttgctgaccgctcataccctcagcaactaattttttcactagctcaagcgttttatcttgtcccattggttgatcttgagtgccattatcaagccctaaaccggattttagatttttaatagcaacaggtggagaagaagtactactactagtttgagttccacctaaagtgatagtatctttcgttttactatcatatttcaccgcaatttcatccgcttctgcctgtttatcggcgatggtttggattttgtttttcacaaattttttcaccgcaccggcagtcgtgagttttttgtcttcagtatcagcatcctctttaatatcttcagtcgcttcaatcttaaaggaaatggtgcctgtattcgcatcaatactcggtttgatatagtcatcaccttttaacttaattgtcgcaccaagttgacgtgtcattttgtttgctgtggtactaccagcctgatctgtagacgttgtagtactactagcgtccacttcaaaaattaaacctttgttaatggtttcgatgtttttatcaatagcatctttgaaagtagctgcggctttgacagattyrtcatcaccattttcatctttcaatttagcaaaagttggtgctttaaacgtttttgtttggtcatcaaccttagcccctaaaatatctgtccctaattttccaaagacttcaatcacaccataaagctgtccgccattaatcgcatcagttgaaccggacatcacgctacctgcggcaacgtgagtaataatgcgttctgcacctgtattgcccacactgacgaccgaattaaatttaccatttttagaagtacctgccactttccaagtaaatgttaaactatttttacctacattaatgtcagtagttttaaatacgtttttcttcgtttccaatttagaatttttccccaaggcgaaagaatcatcatcggctttgttgctaagttgaataatttccaatttatctgttaccttttttgccaatttaagcgtaactttttgttgtttatcttcaaccgctgtttcaatctcatctgttgtgcctaatacttgcaaggcttgcgatctgagtttaacctcagcttgaggttgtccgcttgcagatggcgtacctgagggctgtggtggttgcggttgcggttgtgcttgtgccgtgttggaattatccgcttcaatttttagcgttaatgaatccaattgagttttcaagtaatttttaaccgcactcaccgttactaatttattgccattcgggtcggttgtactacctgaaccccccatgccttgaccattcgtatcaattgaattagccacattaagtttaaaggtgattttgcctccattgttaccgccactgctactttctgtcgccaatatgaggtatttatcgcctttaaacgttaaggtttcgcccagtttacgaatgaaaggattttttccgttttgtgctgatggttgagttgtacttccatcatccaccgcaaacttcaagcctttttccacaagggctttggcgatgtcggacaagtctttcacattgacagcgttgttggaaatgttactgccattactaccaagatttccattgaggacattttcaatattgctagttccgctacttccgccattgctatttacccctaaaccacttccaagtttagtgatttgtttattacctaaatctaagccgtctttgccaaaggtaaatgtgccagtgcctgcggtgattttgaccgttggrctggttgggccaccgctaccattcgtaaattcaatttttgcaaccgcacttccgttacttccgctaattgagctaatacctttcaactcttcattcaaagcaatttctagtgtgtctttgcttgtttttgtgaaaatattttgatgggtatttgttgcaccattttgccccgcacttgtcgctgggcttgaagcatcgcctttcgcccctttaatgttcaaggttgaaccgagatagagttgttgctcgctactgctaccannnnnnnnnnnagtatcacctttaaacttcaagccctcattgagtttggcgatgtttttatcaatcgcgtctttgaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacccaatatactaatgcctaaatgaccgaatgtatgaatgacattgtaaagttgtccgccgttaatcgcatcggttgaaccatcggcaacattacctgcggcaacgtgggtaataatgcgttcagcacctgattttcctatactgacaaccgatttcatttgaccggctcctgcattgctccagccgatttttacttcattttgtcctgtgttttgtatcgttccggnnnnnnnnnnnnnnnnnnnnnnnnnnnnagaatttttccccaaggcaatggaatcgccagcggcggtttcaactttcgcaccttccccaatcgctaccgcacctgcggctttggtttcggcatctttaccgatggcgatagctcctatggcacttgtagcaaccgtcgcttttttccccaacgcaatgccgtaatcggcttcgactttggcaacgctaccgatgaccaccgcggctttccccgaggctttggtaannnnnnnnnnnnnnnnnnnnnnnnnnnnnnnnnnnnnnnntgccgtgccgataacgatactgtacatgcctttgctcatttccgtttccgctacgccaatggctaaagaatgatcagctttagcaccatcgttgtttttgtttgtttcagcctttaagttagtgacagagaaataagtgacaccgccaccgccggcatttttcatcgcttctcgcaattgtcctaaattgacggcgtgggtatcttccgtccccggtgcgacattcacgatttgacggtattttgtatcttttttaccgattgatagtgcaccgccgagtttgtttttgaatttatctgcaaactcttggcttatccatgtttttttttcagcattactctgatcatcttttgtaatcataaaagtgccatttcctgaagggctatcggcttcagattcagcacccaaagcgattgcatcggtatgttgattatccactctcgccttgtaaccaatagcgacggctttttgagattccacagaagaatgtgaacctaaggcggttgaatttgaaccttttgcataagcacgatgccctaaagcaacatcgtcagtttgctccgcataagattgcatacctagtgctactgtttcgctaccataggctatggcttccgaacccaatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcgtttagaattgtatcgggtccaatttttgattcgttagctgttaaaccactcaaaactatattaatatcctgaccatacacaaaactcccagtcaataaaaacgccaacggcagtaatttaaacagccctaaaaaattgcccgaaatcccaccgcactttggtttattttcagaacggctcgccacttggcaatttttcgccaattcagacaccactttggtttgtccagtggttatatcgtatttggttttgaaaatcttattcatggtttactctctttaatcttttaaaatgggttatttaataatttattttgttgatttttttcacttttttatggttgtgaatggattaaactttttgttttttaggtagattaatgaggtataaatcggcgatgccttgctttttaaggcaaagcagaaaaagacgaatgatattttcgctaagggttttaaaaggggaaatttgggtatgacgagaagttaaaaattttttaaaatttattttgcaaggtttataaaaaggcgttagcctaggctgtaggctgtaggctgtaggytgtaggctgtaggctgtcattttttcttttctattttatttgtcaagtaatcattaagcagtagaattttgcgattctatcctaaattttattaagaatgaaatagttttttcattttttttgtttcgatctcgattatatagtgaatcaagatgtttgaggggaaagataaaggcggagtttggctttttttgggttctaattacaggttatgttttggcgagattgctatataatgtcgaattatcttaccgatttatcaattttcttttctttgggagtaaaagatgactcaagcgaagatttattccgtttcacaacttaaccaatccgtacgccaaatgttagaagggcagttgggggttgtttggttgacgggggaaatttccaattttactcagcctgtttcggggcattggtattttagtttgaaagacgaaaatgcacaggtgcgttgtgcaatgtttcgcatgaaaaatatgcgtgtcggttttaaagcacaaaacggaatgcaggttttggtgagagcttccgtgagtttgtatgagcctcgtggtgattatcaattgattattgagtcaataaatcttgcgggggatggcttattgcaacggcaatttgaggcgttaaagttaacattggcggctgaagggttgtttgcacaacattacaagaaaaacttaccgcactttgcaaaatctgtcggtattattacgtcgcctaccggtgcggcgttgcaggatattttgcatattttgcaacgtcgagatccgagtttgcatgtagtgatttatccgaccgcagtgcaaggcaaagaggcaacggcagaaattgtacagatgattgaattagccaatcaacgtcgggaggttgatgttcttattgttgggcggggtggcggctcgttagaggatttatggtgttttaatgaagagagggtggcaagggctatttttcattccgagttgccgattattagtgcggttggacatgaaatagatgtaactattgcggattttgttgcggacgtgcgtgcaccgaccccttctgccgccgcagagcttgtcagtcgtcatcaacaagagttattggatcaattattttatcgtaaacaacgcttggaaatggcgttggatcgttttttccaacaaaaagtgaagttgttacaacgactgcagtttcgtttgcaacaacaacatccgcaaagtcaattaaatattcaacaaaaaatgatgcaacaattacttcatcgtttacatcttgcgttaagtacttttgtcgataaaaaacagcagaaaatgaccgcactttgtcgtcgtttagataattcacctttgccttattatgtgcaaaaacagcaccaaattttggttcaattggagcttcgtttgaatagcggattacaaaaaaaattcaaaaatgccgattatcagcttagtcgattatgtggaaaattagacagtttgagtccgttgaaagtgttggctcgtggttattcgattacgaaaaatcagcagggacaagcgttgaaaaacagtcatcaaattgaagtcggacaactgattaaaacgcaattagagcaggggattgttgttagtcgtgttgaggaagtggcgcattgaactaaaggagcaaacaagtttgctcctttagtttgtgtatggattggggtagttaattgcgtttgccgaaaatagccgttccaattcttaccatagttgaaccgcacttgatcgcacttgccatgtcatcactcattcccattgataatgtatcaattttttcatcaggaaacgccatttgtagttgagtgaataaatatttcatttgattaaatgcttgttcttgtgcggtgatattatcagtcggttcaggaattgccattaaacctcgtaggcgtaagtgcggtagattttggatatgttttgccaaactcaacatttcttgaggttgaatacctgatttgctgttttcagcactgatattaatttgaattaggacatttagtggttgtttatagtgaggacgttgttcatttagacgagtagcaattttttcacgatcaagcgtttgcatccaatcaaagttttcagcaactaattttgttttgttggattggagcggtccaataaaatgccattcaagttgaatatgttgttctataaaatattgaattttttccacaccttcctgcacataattctccccaaatgctgtttgccctgcctgataagctatcagaatatcctcgaccggtttggttttactgactgctaataaggatactgtggaagaatgtctttttgcctgttcgcaatattgagatatttgtcggtttattttcgctaaattgttttttatttgcatcataatgagcaagacctgttgaagttggtttgatatgggcattattttaccttaattattcgacagggggaaatttatgaaaaatttttcattttctatttgacaatagcataaaatttcggtatttctaacgcactcttttttgattttgaaataaccgaatgtataaccgcactttttctattaccacgatgattattaccattaagatgattaatggcgtgggctagtgcataaaaaataggatttacaaagcccgcctcgtaaaaaagtgcgggtttttttattaacgtttttattattaaatcttcacaacatataaggaaaaattatgcgagtactcaaatttggcggcacatctttagcgaatccgcaacgctttttacaagcagcagcacttattgaaaaagcacatttagaggaacaagccgccggcgttctctctgcaccagcaaagattaccaatcatcttgtagcactttctgaaaaagccgctttaaatcaacctactgatggtcattttgatgaggctcttgagattttttataatattattaatggcttatatgcagaaaatactcattttgatcttgttggcaccaaagcattaattgagtcggagtttgcacaaattaagggattattagaaaacattcgtcaggcgggaaaagtagaagatgcggtaaaagcgacgattgactgtcgaggtgaaaaattatctattgcgatgatgaacgcttggtttgaagccaaaggatatacggttactgtgattaatccggtagagaaattattggcttatggctcttatttggaaagtagtgtggatattgcggaatcaactaaacgagttgatgcaaaatctattcctgctaaaaatattgttttgatggcaggctttacggcaggaaatgataaaggtgaattagttttattgggacgtaacggatccgattattcggcagcctgtttggcagcttgtttaggggcaagcgtttgtgaaatttggacggatgtagatggtgtttatacctgtgatcctcgtttagtccctgatgctcggttactttccagtttatcttatcgtgaagcaatggagctttcttattttggggctaaagttattcaccctcgcactattggtcctttagttgagccgcaaattccttgtttgataaaaaatacgggtaaccctgaaggtgcaggatcaattattgacaatcgtgaaaatatttctgaagggctacaggttaaaggcattactaatttagataatgttgctatgttcaatgtatcaggaccgggtatgcaggggatggttggtatggcagcgcgtgttttttccgccatgtcaaaagccagcgtttccgttattttaatcacgcaatcttcttctgaatatagtattagtttttgcgtaccgactaaagctattgaaaaggcaaaagcggcactaaatgctgagtttgaacaggaacttgtcgctaaagatcttgatcctgtggaagtaattcatgatttgtcaattatttccgtagtaggtgatggtatggagcggtctaaagggattgccgctagtttcttttcggcgttagctagtgctaatatcagtattgttgctattgcacaaggctcttccgagcgttcgatttcagcggttgttcctttgaataaggcgattgaagcggttaaagcaactcatcaggcattgttcaataatcgtaaagttgttgatatgtttttagtcggtgttggtggggtcggtggtgaacttattgaacaaattaaacggcaaagtgaatatttggcaaaaaaagatattgagattcgtgtttgtgcgttggctaattcgaataaaatgttgttaaatgaaaatgggttaaaacttgataattggcgtgaagatttggcaaatgcaacgcaaccgtcagattttgatgtattgctttctttcattaaattacatcatgtggttaaccctgtttttgtggattgcacaaccgctgaaagtgtagcaggattatatgaaagagctttgaaagaaggctttcatgtgattacaccgaacaaaaaagccaatacccgtgagctggattactataaccaagtgcgtgaaaatgcacgtaaaaatcatcgtaaattcctttacgatactaacgttggtgcaggattgcctgtgattgataacttacaaaatctattagccgccggcgatgatgtagtgagttttaacggtattttgtcaggatctctctctttcattttcggtaagttggaggaggggctttctctttcagaagctaccgcacttgcccgtgaaaaaggctttacagaaccggatccgagggatgatttatcagggcaagatgtggctcgtaagttattgattttggcacgtgaaatcggtttagaacttgagttgtcggatattgaggtagagggcgttttaccgcaaggtttctcagagggaaaatcagcagatgaatttatggcgatgttgccttcattggacgaagaatttgcagaacgtgttgcaaaagcaaaatcggaaggcaaagtattgcgttatgtaggacaaattgaagaaggcaaatgtaaggtttctattgttgcagttgatggagacgcaccgttatataaagtgaagaacggtgaaaatgcgttagctttttatactcgttattatcagccgattcctttgttattgcgtggttatggtgctggtaatgcggtaacggctgccggaatttttgccgatattttaagaaccttaaaacattaattggagtgataaatgttaagaatttatgcacctgcatcaagtgcaaatattagtgttggatttgatacattaggggttgcagtatctcctattgatggttcattgttaggtgatgtcgttcagattgaagaaattgaacagggatttgaactggaaagtacggggtattttgtgcgtaaattgccaaaagaaccgcaaaaaaacattgtttatcaagcctatgtgttatttagtgaacgtttaaaattacgcaatctgaaaataaagccgttgcgtttaacgttagagaaaaatatgcctattggctcgggattgggatcaagtgcttgttctatcgtggctactttagtggcgttaaatcaattttatcagcagccattttctaaaatggaattgctggaaatgatgggcgaactagaggggcgaatttcaggttcaatacactatgataatgttgcaccttgttatttgggcggtgtgcaattgatggtgcaatctctaggtaatattggtcagcaattacctttctttgataattggtactgggtattggcttacccgggaattgaagtttcaacggcagaagctagagcaattttaccgaaaagctatactcggcaagatgtgatttctcatggtcgtcatttagggagttttgtacacgcttgtcatactcggcaggaagcattggcggcttatatgatgagagatgttattgcagaaccttatcgtgaagcattattgccaaattttgctgaggttaaacaggcagtgaaggatttgggcgtacttgcttcaggcatatctggttcaggtccaactatgtttgcgattgctccggatttagctattgcgactaaatcggcaacttatttagaaaacaattatttacaaaataatgagggctttgtgcatatctgtaaagtggataatgtgggtgcaagggctttagtttaacgagaacaagttatgaatttatataatattaaacatccggaacaacaagtaagtttttcacaagctgtgcgtcaaggtttaggaaaagatcagggcttattttttcctgaaaaattaccgcactttgacgacattgatagcctcttatctttgcctttggttaaacgcagtcaaaagattttaactgctttaattggtgcggaattgtcacaagaaactattagtgcaatggtaaaaaatgcctttacatttccggcaccgatggtcaaagtagaagataatatctatgccttagaattattccacggtcccacgttagcttttaaagactttggaggacgttttatggcacaagccttagcagctgtgcgtggagacagtaaaattactattttaactgctacttctggcgataccggtgctgcggttgctcatgctttctatggcttagaaaatattgaggtagtgattttatatccaaaaggtaaaataagtccgttacaagaaaaattattttgtacacttggcgggaatattcgaactgttgcgataaacggtgattttgatgcttgtcaagcattggtgaaacaagcctttgatgatgaagaacttcgtcaagctgttggtttaaactctgcgaattcgattaatatcagtcgcttgttggcacaagtttgttattattttgaggcggttgcacagttaccgaaagaaatccgtcaagacattgttatttctgtgccgagcggtaatttcggtaacttaacagcgggattaattgccaaaactttaggcttaccaatcaaacgctttattgcggcaaccaatgccaatgataccgttcctcgctatttgaatagcggaaaatggcagcctcatacaacggttgcgactctttccaatgcaatggatgtgagccaaccgaataactggcctcgtgtagaagaattatttaaatgtaacggctggtctttaagtgaattgggttcaggtgcattgagtgatgaggaaacagaaaaaaccttgcaggcacaatatgccaaaggttatttatgcgaaccgcatggggctattgcgtatcaggtgctaaaagatcaattacaggttaatgaaacgggtattttcctttgtacggcacatccggcaaaattcaaggaaaacgttgagcgtattttaagtctcgagcttgtgcttccggaaacattggataggtacaacaagttgccattgctttctgatgaaatggaaaatgacttcgctcaattacgtgcttatttattaaaaaaataaagcattttaaattaaaagtgcggttgaaagtcggaaagtttcgattttatgtacatataataaaagagtgggattcccactcttttgtttgctgtactgtttttttagacaagaaaaacttttaattcgggagcttatgcctcttattttcttgatagacttgcttgaattttattttttgccactttcatcacagttttgtacattgctacattttccgtaaagatacagattgtgtgtttttaatttgatgccatgttccgcactgatttcacgttggcgtttttcgataacttcatcattaaattcaaagactttgccacaatcgacacaaataatgtgatcatgatgttcttccggtgctaattcaaaaacagatttgttaccttcaaagttatggcgaataagaatatttgcctcatcaaattggttaagtacacgataaacagtggctaaaccaatatctttaccttgttccagcaacattttatagacatcttcggcggagaaatgttgcattgtgcctctactttcttgcattagagacaaaattgttaagcgtggttctgtaatttttaaacctgctttttttagtagcttgatattttcttcagacatggtagctcctcaaattttatgccagttcagctaaacacatttcgtcatacacttgtttaacccatttttctacacgttctgcggtgagttctggttgacgatcttcatcaatacataaacctacgaatgtattgtcatcaactaaggcttgcgagacctcaaaagtataaccttcggtcggccaatgcccaacgataattgcaccttttggttcgataatattgcgtaccgtacccatcgcatcacagaaatactctgcatagtcttcttgatccccacaaccaaaaatagcgactaatttatcggtaaaatcaatttcttctaaggttggaaagaaatcgtcccagtcacattgggcttctccataataccaagttgggataccgatcattaaaaaatcatagctttcaatgtcttctttactacttttagcaatatcacgaatatcaatgagttctgaacctaattgtttttgtatcattttagcgatattttcagtattacccgtatcactaccataaaataaaccgacaatagccatttttatctatttccttgaattttaaaataatcttttaagatcgttataattaactctcaatgtctaatcgcttgttcagacgcctgacttctaactgctgaactaaatccgcatgtaacttttactcaatacgttttaaaatgctaaatttatcgcattgaagttgattacatttgtttattcggagctgttgttcatgaagcagtgaatttgttctaggcgtcctactttgggaagcgtcgcaaacagatttagtgtaatacaatctgcatcttgtttagccgttttcaaaccactgaaaatatatcaattctagcctggttctaattgagaatgataagctacaagcaaaatttgaagcgaactataacacaatttatgagtgaattaaaccctatagatcaagtaaacatgagaatttttatgacaaaaaacgctgaattgatctaatcacaaaatctgctttttcagcatgtacccaatgcccactttcattgatggtaaaagaggtcgcttgtggaaattgagcgagaatttgttcactgtattccggcaaaatgtaattcgataatccacctcggataaacagtgttggtttgttaaaaaatccttttttccaatccatgatttcagcgtaattttgtttaagtgcggtgagattaaagcgaaatttttcttttgcttgtgcatcgaaagacttgagcataaattgctgtacgctttcttgtggaatatagttagccagtaattgttttgcttgttgacgagtttccgattgtgctttacttacggcaaaaagtcccgcaaatacactgttgtgttcattgttgctataattgaccggtgcaatatcaatcacaatgagcttttctattaagtgcggtcgtagcattgcacatttcatcgctgtttttccacccatagaatgcccaattaaaataacgttggttaaattcaaatgatcaatgacttgtagaacatcttccgccatcagctgatagttcatttcttcactatgaaaactttgtccatgattacgtaaatcaagacgtaaaatagggtatttttcggaaaaagcacgagcaatgacaccaagattattcatatcaccaaataaaccgtgaatgaaaacaagagtgggtgagatttgcgagttgtttatagcgtgaaattggtaattgagtaatttagtcgtgggcataatttttgcgtgtgtatttgtaaagaaatcgttataatgtgcgaaaaattcaaatagatcaagtagaaatctcttgtaggcttgtaatgtaaaaggagttcggttatgaaaattattgaagttgacgaagagctttatcagtatattgccggtcaaacgaagtctatcggtgaaagtgcgtctgatattttacgccgtttgttaaatcttccttattctaacgtagcaagtgcggtacaaaattcggaaaatgtatctacagaagcgattttaccaaacacttgtatagaaagtgaacaggaagttcaaacgaacgaattaataaatattcctgtcaaaaagcagtctgatgaagctattcagaaaattgttgataaagtaagaaatcttttatattcagaagaattccagcaagaaacgaaagctgttgtgcgttttttgagcttgttgcgtacactttaccgcactaatccggaaagttttgcattggcaacggaaagtttgcaaggtcgaacaagagtttatttcgcacgtgatgaggctactttactggtagcgggtaatcatacaaaaccgaaacaaattcccgacactccgttttgggtgatcactaatactaatagcggtcgaaaaatgttgatgttggaaagtgcgatggaatctatgcatttaccacaagaacttattgaagaagttagatctttttttgtgacgaattagcgatgttcttttggcataaatatgcactcactcccttatttcaatcaaaaatagccttgcgaaactcgcaaggtgaagtctttacttggcaacaactttgttctttaatcaatcggcaatctctactttttcagcaacaaggtgttaaagctggttcgggcgtgttgttatgtggtaaaaatgatttttcattattgttggcttatttggcaactattcagttgggagcaagagttttaggtgttaatccgagttttcctgccgataaaattcagcatatcgcagaatgttatcaatgtgattttatttttaataggactgctttcctgtttaaaaatatgcaaaatttgaccgcactttctgcgagcgactgtacgcaatatgtcgatgttttacctgacactgaagttaaaatggatttgcaggctgtggcaactttaactttaacttcaggatcaagtggtttaccgaaggcggttgtacatagtttgcaggggcatttagataatgcgattggcgtttgtgagctaacccaattcagtgcaaaaaacagttggcttttatctttgcctttatttcatgtttccggacaggggattatttggcgttggttggtaagcggtgcagaattgcatttaccgcaagaggatttttatttttctgttagtcaggcaagtcattgttcgttagtaccgacgcaacttcaacgtttattcgattattggcaacaaaatcctactctctcacgttacacagagcatattttgttaggcggtacgcaaattcctacgcagttgactgagaagttggcacaatacagtataaaaagttacaccggctacggtatgacagaaatggcttcaacggtttgtgcaaaattgagtgatggtaaacgtggagtagggcagccgttagcggggcgtgaagtgcggttagtttgtgatgagatttgggtgcgaggtgctggtcttgctttgggttattggcaacaaggtaaaatttgttctttactgaatgaacagggttggtttgccacaaaagataaaggcatttggcaagataatgaattgcacattttaggacgcttagataatatgtttatctccggcggggaaaatattcaaccggaagaaattgaacaaattattggacagaatgaaacggttgcacaggtttttgtattgcccattgatgatgttgaattcggacaaagaccggtggcaatgattaaatttcacgatgttttttctgaacaggcagtacatgaattacatatttggttagcggataaattggaaaagtttaagcaacctattcaatattttccattgctgttgcaatcacaaggaaatatcaaaatttctcgtcatcagttaaagtctgagctaactcgtttattaggaaagtaagtatgaagaagataaaaaataaatttaaacaagttgccatgattggcttattctctttagctcagtttgcactggcaggagcaattttgaccgaaaatgatgtaaagatgcgacttgatgagattaaaaaaatcgaacaaccccagcaagaagataaaagtgcggtgcaaaacttggaagaaacattgtttctcttaggaaaaatagcaaaacagaaagaagacaatctaaagttacaaaaactgattcaagatgcaccaaatgagcaaaagaacatcagagaggaaatcactacattaaaagaggcgtttgttgttcgtgattttgataatttgtccatcgggcaattagaggataacttagcaaaaatacaatccgaattacaacaagttcaagctgatttagtacaagctaatgcacagttagttaatcaacattctgcaacagagcgggcacaaagtgcgttaagtgccaatattgttcgtacacaagaaattgataaattgtcttttagtgttgatattgcacctgaggagcaaaataaattagctacagaaagtgcgttaattgaattacaaaatgactacaatcaaactgtattacaagggaataatgaactcaccgcactttatactttgcaattagaattgaaaaatcttgtccaacagcatttacaagctacgcaaactgcgttacagacggaaattaatcgacgtaaattagtgcaaactgagcaacatgtggagcaactaaaacagattcaaaaggaagcagagggtaatccgttattagttcagcaacaacaaattaatattcagattggacaagatttagtggaacaaacaactaagctgaacgctttgtcgcaagacaatttgcgtattaaatctgttttggataatttgcaacaaactgaacgtaatattaatgaacaaattagtgctttacagggaactttagttttatctcgaattattaataagcaaaagcaattattaccgcacgataggatgattacaggattatcaaatcaaattgccgatttacgtgtgaaaattttcgatttaacggagttaagagatagcctttatgatattgacggttatatttccaatatagaaagaaagcaaggggttacttttggaatggctgaacacgcacagctcagcaaaattttacgggagcgtcagaagggtatttctgatttggtgtctattttaaatgatcaactcaatctttcaatcaatattgaattaaatcaaaaacaagtcaatttaattagtgatactttacaagaaaaactccaacaacaaagtttctgggttaagagtaatacacctattgatttggattgggttaagcgttttccttcactactaaaaatagaattggaggatattcgtacgcaatttaatttcaacaattggcaagataatattatttctgccactgtgttaattgttttccttttatccatcgccttttttatttcttggcgtaaagaaaaaattaagcaacggttgaattatattaatagcaaaattaatacgttacaggaagatagacagctttatactccggaagctgttttttggacgattattctttgtttaccgatgacgttagttgtcttagtcggtttaattgttattacttttatttgttttaatgatcctgaaaaattctggttgtggtcagtaagaatgtcgggttattggtggcttttcgcttttatgttagcgatgttacgcccaaatggccttgcttatcgtcattttagtatgcctaaacataatgtagagcttttttccaatgtgatgaaacgatcagtatggattactgttctttggcttaatgcctctatgtttacttatttagatggaggaattgctaatgatgtgattggtcaattgatgacaattgcggtcttagttatttcactgtttattattggacctcgtatgcgttatgcagtccaagcttatgaaaaaaactcagaaaaaaaacctttcctaaaagttttccgcattgtgttgctactctctcctattattctcattgtgttggtagttttaggttattactacactacgttaaatttgatggatcatttgatgtcttcttattttgctttgatgatatggatagtaattcgcaatatagtgtatagaggatttactatttctgctcgtcgtttagcttatcgtcgtttgcaagaaaaacaaaagaaaacacaggtacaatctcaagatgtggtggacaaagaagagtttaaccttaatacacaagaggaagttttagcaatttcagccgttaaggatcaagttttgcgagtgacggatttagttttactcgtcggcttaatcggtatgttctattgggtttggtctgatttaattacggtagcttattatttggaaggcgtaacgttatggaatcaaaccgccataacagaagttggtacagttattgaaactattaccctgtggaatttgttattagcactgattattttaggcatcacgtatgctttagtgcgaaatattggtggggtattggaagtattaattttttcaagagttaatttttcacaaggaacaccttacaccataacaactttactgatttattttatcattgcaatcggtagtgctatggcattctctactttgggtatgtcatggtcaaaattacaatggttatttgccgcactttctgttggtttaggttttggtttgcaggagatctttgctaactttgtatcaggtatcattattttatttgaacgtcctgttcggattggtgattttgtaacaattgacaatttttcaggaactgtgtcaaaaattagaattcgttccacaacaattatcgattctgataagaaagaagttattgtacccaataaagcctttgtaacagagcgaattgtgaattgggcattgaccaattctatgactcgtgttgtgattggtgtcggtgtggcttacggttcagatttagaattggttcgtaagttgttgttgcaggcagcgtatgaaacacctacggttttaaaagaaccggaaccgtctgcttattttatagcgtttggtgcaagtacattagatcacgaattgcgggtttatgtgggtaaattgtcagatcgtatgactacacaagactttttaaatcgtcgtattaatgaactatttgcacaacataatattgaaattgcatttaatcagttggatgtatttattaaaaatcaaacaacaaatgaagaagtaaaagtactttcagagaatttacaaagataaaaggaataaaaaaatatggcgggaaatagtattgggcaacttttcagggtaacgacatttggagaatcccatggtattgcgttgggctgcattgtagacggtatgccgcccggacttgctttatccgaagatgatattcagccggatttggatcgtcgtaaaccgggaacttcaaaatatactacgccacgccgtgaagaggataaagtacaaattttgtccggtgtgtttgacggaaaaaccacaggaacaagtatcggtatgataattaaaaataccgaccaacgttcgcaagactatggtgaaataaaagatcgttttcgtccggggcatgctgattttacttaccagcaaaaatatggtttacgtgattaccgtggcggagggcgatcttctgcacgtgaaacagtgatgcgtgtagcagcgggggcaattgctaaaaaatatttgcgtgagtattttggtattgaagtacgaggttatttatcacaaatcggtgagataaaaattgatccgcaagtggtagccgatgtgagtaaaattgattgggcgaaagtaaatagcaatccatttttttgtcccgatgaaagtgcggtggaaaaatttgatgaattgatccgagaattgaaaaaggcaggaaattctattggggcgaaattaaccgttgttgctgaacatgtgcctgtcggtttaggcgagcctgtttttgatcgtttagatgcggatttagctcatgctctcatgggaattaatgcggtaaaggcggtagaaattggtgacggttttgcagttgttgaacaaaaaggaacggaacatcgtgatgaaatgacaccggaggggttttgttccaaccatgccggcggtattttgggcgggattagctctgggcaaccgattatcgctaccattgcgttaaagcctacttcgagtattactgttgtagggcgttcagtgaatttaaataatgagcctgttgacgtgattactaagggacggcatgatccttgtgtgggaataagagctgttccaattgctgaggcgatgatggctattgttttattggatcatttattacgctttaaagcacaatgtaaatagaacacataactatgttaagaaaggtaaagttaatgctgaaaactgcggtttttttgaccgcactttttttcactcagatattaagtgccaatccacaatattggcaatcagtgaaacggcctattcatggtgaggcaatgcctataggaagttataataatggctgtcttattggtgcggaagcattgccctttaatggtgagggatatcaagctatccgtactaataaaaatcgttattatggacatcccgatatgattgcttatttgcaacgtctcggtaaaaaagcaaaacaggcaggtcttccaacgattttaatcggtgatattgctatgccgggaggaggacgatttttaaccggacatgccagtcatcaaatgggacttgatgcagatatttggttgcgtttaggtaaactttcggctaaagatgcacaagatccaagtggaatgggactgttggttgttgaccgaaaaaaacagagagtcattgataaattgtggtcaaaagatcatgaaaatctgattcgtttagctgctcaagatccacaggtcagccgaatttttgtaaatcctgcgattaagttgaaattatgccaaacagtaaaaggtgatagaaattggctacaaaaaattcgcccttggtttgggcatgatagtcatttccatgtgcgtttaacttgtccaaaagatgctaaatactgtgaaaatcaattgccaattccggcgggagagggatgtggtgaagaactttattcttggtttaaacctgctaaaccaagtgaatttaagcccaaaaaagtggtgccggaagccccttttctttgtcaacagttaataagtgcaccaaatcgtcatgagtggttagaataggaataatatgatagtagaaattactcttcaactaatgttaattttgtttttggtcgctatgatagccggctttatcgatgccatggcaggtggtggcggtttgattactattcctgcactattgatgactggtatgtcgccggcattggcacttggtacgaataaattacaggcttgtggcggttctttttctgcaagtttatattttttacgcaaaagagcggtagatttgcgtgcttttttgttgattattgtcatgacttttttgggggctgcattaggcactttatctatccaaagtgttgatgcaatcttaattaagaaagttttgcctttcttggttttgattattggcttatattttttattgactccatcacttggtaataaagatagacaaccccgtatttcttatagtttatttgcattcagtatcggtctgacagttggtttttatgatggtttttttggtcccggaacaggctctttactgactcttgcttgtgtaagtttactcggttttaatttagcaaaagcaacggcacatgcaaaagtgttaaattttacttcgaatattgcatcattgctttttttcttacttggagaccaaattttttggaagttgggcttggtcatgatgcttgggcaatttattggtgctaatttaggcgctaaaatggtattaacgaaaggaaaaaccttaattcgtcctatggttgtattaatgtcttttattatgacggttaaaatggcttatgagcaagcttggtttagctggtaaaccgatgaattattggagtaaacatgacagaaaataatgatttacgtttaaccgcacgggtcggatatcaacctcattactcttggtcctatttattgcctaaatattggggtatttggctcggtatttttgctttattaattttagcttttgttccttttcgctggcgagataaattggcaacaaaattgggcagaattatcgctcgtaaagcgaagaaacagagacatcgtgctaatgtcaatttgcgttattgttttccgcattggtcagaaaaacagcgtaatgaagtgattgaaaatatgtttattactgttactcaagtgatgcttgggatcggtgaaattgcattacgttcaaaaaaacacctgaaaaaacgtagtgagtttaaagggttagagcatgttcagcaggcaagagcggtaggaaaaaatattattttaatggtgccacatggttgggcaattgatgcctcggggatcattttacatgcacaaggaatagcgatgacttctatgtataacccacatcaaaaccctcttgtagattggttatggacaatgactcgtcagcggttcggtggaaaaatgcatgctcgtcaaaatggaattaagccttttcttaatcatgtaaagaaaggtgaaatgggctactatttacctgatgaagattatggtgaggaattgagtgtttacgctgatttttttgctacttataaagctactttgccgggattaaataaaatggcaaggttggcaaaagctgttgttattccgatgtttccacgttataacgcacaacgtgggaagtatgaaatagaaatttgtgcacctttagaattaacggaagatccagaacaatcggcgagaatgatgaatcaagcaatcgaatactttgttactccaacaccggagcaatatgtctggattttacgcttattaaaaacccgcaaagataatgaagatatttatcgttagcttgggcaatttgtgctaaactttgtgccgttttgttgaataaacttttctcatagaatcagggaataaaatgaataaattagaattgattaaatcctctattaaatctattccaaatcaccccaaagaaggaattattttccgtgatattaccagccttactgaagtacctgaggcatttcaagcaacaattgacttaattattgagcgatataaaagtaaaggaattactaaagtgatcggtactgagagccggggatttatttttggggcgcctgttgctttggcgttaaatgttccctttattttggtacgcaaaccgggcaaattacctcgtgaaactatcgcacaatcttaccagttggaatatgggcaagatactttagaaatgcatgtaagttctattcaagccggtgataatgtacttgcgattgatgatttattagcaactggtggaactattgaagcgactgtaaaactggtagagcgtttacaaggtcaagttaagcatgccgcctttgttattagtttgccggatctcggtggtgaggttcgtttacgtgaacttggtgtggagccatttactttagtcgaattttcaggtcattaatttcttcaaattaatagagatagataggcaatgagttatcaagtattagcaaggaaatggcgtcctaaaactttttctgaggttgtgggtcaagagcatattttgaccgcactttctaatgggttatgcgaaaatcgcttgcaccatgcctatttgttttctggcactagaggcgttggaaaaacttctattgcacgtttatttgccaaaggtctgaattgtattaggggggttacggcagaaccttgtggtgaatgtgaacattgcaaggctattgaggaaggtcgttttattgatttaattgaaattgatgctgcttcacgaactaaagtagaagacaccagagagttgcttgataacgtgcaatataagcctactcaaggacgctataaagtttatctgatagatgaagtgcatatgctttctcgtcattcttttaatgcgttgttgaagacgctggaagaaccgcctgaatacgtaaaatttttattggcaacaacagatccgcaaaagttaccgattacgatcctctcacgttgcatgcaatttcatctaaaagctttatcagaaaaacaaattgcacagcatttagaatttattttacaacaagaaaatattccttttgaatatcctgctttggaaaaattggcaacagctgcacaaggtagtattcgagacagtttaagtttaactgaccaagctattgctatgggcaacgctaatgtaagtttggatacagtaagtatcatgctgggcttattggatgacaatcagcctattgatattttatatgcgttacagcaaggcaatggtgaaatgttaatgaaggcaattcaagctgtagcggaaaaaggtgctgattgggataagttactggtaactttagcggaaaaattgcatcaaattgccatgctacaacttctgccacagcaaataaatgaagaaaactcgcttggatttttagctaaacatattacgccggaagatgtacagtttttttatcaggttattgttagcgggcgtaaagaattagcatctgcccccaatcatcgtattggtgccgagatgattttgttgcgatccttagcgtttcaccctaagttcattagtccttcttcagcagcaccaatagaacaaagtgcggtgcaaaaatcacaaaatattgttcaaccgcctttagttgagatgcccgttgtttctgttgccgagcaattaccttcgcaaaatctcattcgtaaaccaacgatagcagataaggtcgatactaagttaagtacaacagctttaagtgctttagaagcgttagaacagttgtcacaacctagtgatcattcagatagcgaaaaaaaaaactcgccgatagataatattcatgatatttctttaagagaaaacactgaaaatatctccgcacttcctgttctaaatgttgtgcctaaagatgttgataatgcacttaagacggttactgtcattgataagagtgatcatagaagtgatgaaattcaagaggatagtgctgagaattatcgttgggaatggcgaaatccggaaatggcggttgaggaaaaggctattcgtccttctgaaataaagcaagctattttagaacaagcttctccggagctcatacaacgtataattgctacggcacaagaaagagatgattggactcggatcattgagcaattacctttgagaggtatgacaaaagacatggcgttaaataccgttctattaaatcaatcgggggatcagatcgttttatccttaatgtctgataaacagcatttgttagatcgttgtcataaagaattaaagcaagcattatcggatttctatcaacgtgatattcagttattaatcacacctactgacgataaaaatttagccactcctttatattatcaaaacttagtttatcaagagtttaatgagcaagctaaaaaagcgttacaagaagataacagcctaaaattattagaaaaagaatttgccgctacgctggatttggatagtgttagaccgatttgacatttttactacgatttagatattgtcttgagctttgagcaatgattatataatgatgaaaaaagctaaaaatcgactgcactttttctttatttgcgatccggatcgcataaatgttttttgatgacaaattctcttttcccaaatacaagaaaattgctagattaatcctattgaacaaagtacaatctccgcctctttttgatcatcaatgaatgccataaggtgtaataacggggcaataaataataaatgtcggacaaaattaatttaatgaatttaactcgtcagcaaatgcgagcattttttcaggagttaggtgaaaaaccttttcgagcagatcagttagttaaatggatttatcattttggtgaagataatttcgatcatatgactaacattaataaaaaattacgtgaaaaattaaaaactgttgctgaaattaaagctccggaaattgcagttgagcaacgttcagctgacggtacgatcaaatgggcaatgcaagtaggagatcagcaggtagaaaccgtttatattcccgaaacggatcgtgctacgttatgtgtatcttcacaagtagggtgtgcattagcttgtactttttgttcaacggctcaacaaggttttaaccgcaatttaactgtatctgaaattattggacaggtttggcgagcttcaaaaattatcggtaatttcggtgttactggtgttcgtcctattacaaatgtggtcatgatgggaatgggagagccattattgaatgtggctaacgttgtaccagcaatggaaattatgttggacgattttgcttatggtttatctaagcgtcgagtgactttatccacttccggtgttgttccggcactagacaaactgagtgaaatgattgatgtggcattggctatttctttgcatgcaccgaatgatgaattgcgtaatgaaatcgtgcctattaataaaaaatataatattaaaatgttgatggagagtgttaatcgctatttaaatgtttcaaatgcaaatcacggtaaggtaaccattgagtatgttatgttagatcatattaacgatgggactgaacatgcacatcaattagcagaggttttgaaaaatacaccgtgcaaaattaatttaattccttggaacccgtttccggatgcaccttatgctaaaagctcaaatacacgtatagatcgttttcaaaaaactttgatggagtatggttttacagttattttacgcaaaacaagaggtgatgatattgatgcggcatgtggtcaacttgctggtgatgtgatagatagaacaaagcgtacggcacagaaaaaacggtttggaaaagaaatcggcactcatcaaatttattaactatttttaatgtataaggagagaaaactaatgcgatatcggactatatttacttttattatattctctctttttctttctgcttgcgtttctcagcctacaactggtcgctttaataagcaacaagctgcaaaagcacgaattgagttaggtttaggttatttaaaattacgcaatttttctcaagcaaaacttaattttgataaagctttattctatcaacctgactattatttggtacattcggcttttgcctatttatatcaattacaaggtgatatttcgcaagcgaaatcctcttatgaaaaagccatcagtttggataagtcgcaaggtgatgtgaaaaataattatggtgcatttttatgtagtcagggcgaatttgctcgtgcttatgagttatttgagcaggcacttattacgcctaattattatcagcaagcggatacctatgcaaatatcataatttgtgcagaggcggaacataatattccacgttatcagaaatttttacagttactgaagaatattgatcccaaaagagcggaggaaataaagaaagtttcttagcttagttagcgtgagttgaaagatcaaaaatggcaagactgtcttcttgccatttttattatattatgattttttgatgtaattagattttacaagctcctcctgcacaagcgtcatcaagatcttcttgcatatcttctgcaccatctctagtgttttgataatacagggtttttaatccatatttgtaggcagttagtaaatcttttaataaaaccttcattggtactttaccatcttcaaaacgttttggatcatagttagtattcgctgaaattgcttggtcaatgaatttttgcatgataccaactaagtgtaggtatccatcattacttggaatatcccacagtaactcatagttttcacctaaattctcataatcaggaacaacttgctttaaaattccatcttttgacgctttaatactaacatgtccacggggaggctcaattccattggttgcattagaaatttgagaagaggtttctgatggcattaatgcagttaatgttgaattacgtaaaccaaattcttgaatttctttacgcaaggcttcccaatcgtaatgtaaaggctcttttgttaagttatcaatatcttttttgtaagtgtcaataggtaagatcccttgtgcataagtggtttcatggaagtattcgcaagcaccgatttcttttgccaaattcattgaagcttttaataagtaatattgaatagcttcgaaagtgcggtgtgttaaatcattcgctgaaccatcggagtaacgaacattattttttgctaaataataagcatagttgataacaccgataccaagagagcgacgagctaatgaactgcgttttgctgcagcaacagggtagtcttgatagtctaatagggcatctaatgctctgactgcaagatcggctaattcttccaactcgtctaaattttcaagagcacctaagttaaatgcagataatgtgcatagtgcaatttcaccgttttcatcatggaaatgttgcaacggtttggttggcaaggcaatttccaagcataaattagattggcgaattggtgcaaccgcaggatcaaatggcgaatgtgtgttgcaatgatccacattttgaatataaatacgaccggttgacgctcgttcttgcattaataaagaaaatagctcaacggctttgacactgcgtttacgaacagcgggatcttgttcatatttgagataaagcgtttcaaatttattttggtcagcaaaaaatgcttcgtataaccctggaacatctgatgggctaaatagagtaatttcaccccctttaattaagcgttgatacatgagcttattgagttgaactccatagtccatatggcgaacacgattgtcttcaacccctcggttattttttaataccaataaactttcaacttctaagtgccaaattggataatagacagttgccgctcctccacgaacaccgccttgtgagcaagattttaccgcagtttggaaatgtttatagaatggaatgcaaccggtatggaatgcttctccattacgaatcggactgcctaaagcacgaatagcaccggcattaactccaatgcctgcacgttgagaaacgtatttcacgatggctgatgctgttgcattgattgagtcaagactatcaccgcactcaattagtacacaagaactgaactgacgagtcggggtacgcacacctgccataattggcgtaggcaaagagattttaaaggttgacgtagcatcatagaagcgatgaatgtagtccagacgagtttcttttggatatcttgaaaagagacttgcagcgactaacaaatataagaattgtgcagactcatagatttcacctgttactctattttgtacaagatattttccttccagttgtttcacagcagcataggagaatgtcatatcacgccagtgatcaaggaaaccatccatttcatcccattcttcacgtgtataatctgttaataacgcctgatcatattttcccatccgcacaagtttttttacatgatcataaagttttggcggctcgaaatgtccataggcttttttacgtaaatggaacactgctaaacgagcagctaaatattgatagtcaggactatctttactgataagatctgcggcggctttaataatagtttcatggatatccgaagtgcgaattccttcataaaattgaatatgcgattttaattcgactaaggaaacagaaacattttccagtccttccgccgcccaagtaatgactctgtggattttatctaaatcaataggttctttgtttccgtcacgttttgtgaccatcaatgctttattcataggatttccgagaggttctgatatggttaaaacacaagatatagttataaatcaaaaatgaactacaagataatgggttggacggaaaaattcaagtaataaatttcatctatgattcttgacagaaaataacttacttataaataagtaaaaaatgaaaaagtaataaaaattattatcaaaaattgtgctgtagatcaaaatttatattttttgatatgaataaaatgatctttattctttgtggcaataaaaaagccgttcaaagaacagctttcaagggttattttcctaaattatcaaagaatttttttacaccatctaaaaaacctgaggatttagggcgttggagcgttttaccttctaaacttttttccaattttcttagtaactctttttgttcttcgtttagtttaattggtgtttcaataacgatctcgcagattaaatcgccagcatagccgcgagaggtaatgccttttcctcttagacgaagcagtttaccggtttgtgtttcagcaggaattttaactttaagacgaccgtctaaagttggaatttctacttcgccacctaatgcagccatagtaaagctgatagggacttcacaataaagattgttaccatcacgttcaaaaatatggtgtttttttacatgaataactacatataaatcaccggcaggtgcaccattttcacccgctgctcctttacctgctaaacgtaattgattacctgtatctacgcccattggaatggtaacggtaagattttgggttttatgaactctaccttcaccgtgacaggtatgacaaggtttctctatttttttgccagtaccgtgacagtgtggacaagtttgttctgtaacaaagaaactttgttggcgacgaacacgacctgcaccatgacaggttggacaagattcaatttttgaacccgcttccgcacctgagccatgacaagttccacagtgaacaagagtgttaatttgaatatcttttttacagccttttaccgcttcttccaaacttatttcaatatcgtagcgtaaatcctcaccacgaacaacacgttgacgagaacgcccgccaccaaaaatatcgccgaacatatcgccgaaaatatcaccaaagtcagctccgctaaagccgccgaaaccgccggcaccaccaccttgttcaaaagcggcatgaccatattggtcatacattgcccttttctctttatcagccaaaacttcgtatgcttcattaatttctttgaatttttcttcgctttctttatcacctttagttcgatccgggtgatatttcatcgcaaggcgtttgtaagcacgtttgatttctttatcatccgctcctttttgaacacctaatatttcataataatctcgttttgccatgtgtaatccggttagttgttgcgttataaacgctgatagtcatacgttgaaagggcgtattactacgcccttgactctgattagtgagatatacagattatttatcttttacttcttcaaattcagcatcaacaacatcctctccacctttcgtactttgagattgttgtgcaccggcatcagcttgtgcttgttgttgacttgcttgaagtagtttttcggaaacttgaattaatgcttgtactttggcatcaatttcagttttatcttcaccttttgccgcagtttcaagttcattgaccgcactttcaattggtgctttgtcttcagctgataatttctctccaacttctgctaattgtttgcgggtactatgtactaagtgatccgcttggttacgagcttgaactaactcttcaaatttacgatccgcttccgcattagcttccgcatcacgaaccatttgttgaatttcttcatcacttaaacctgaagatgctttaatcgtaattttttgttctttaccagtacctttatcttttgctgaaacatggataataccatctgcatcaatatcaaaggttacttcaatttgaggcataccacgtggtgcagggttaataccttcaagattaaattgacctaaagacttattggcagaggcttgtttacgttccccttgaagtacgtgaatagtcaccgcactttgattatcttcagcggttgaaaatacttgcgattttttcgtcggaattgttgtatttttctcaatcaaagttgtcatcacgccgcccattgtttcaataccgagtgataatggtgttacgtctaacaataaaacatctttaacatcaccggctaaaacaccgccttgtacagctgcaccaatagcaaccgcttcatccgggttaacgtctctgcgaggctctttaccaaagaattcagcgactttctgttgtactaacggcatacgggtttgtccgcccaccaaaatgacatcattgatttcggaaacgcttaaacctgcatcggaaagtgcaactttcacaggctccattgaacgtgcaactaaatcttccactaacgcttctaatttcgcacgagtcaatttaatgtttaaatgtttaggtccggtagcatcagcagtgatataaggtaaattgacatcagtttgttgagcggaagaaagctcaatttttgctttttcaccagcttcttttaaacgttgcattgcaagtggatcgttacgtaaatctacgccctgttcttttttgaactcatcaactaggtagttaattacacggttgtcaaagtcttccccccctaggtgagtatctccgtttgttgctaaaacttcaaacgttttttcgccaccgacttcatcgatttcgataatagataagtcaaatgtaccaccacccaagtcataaacggcaattgtttggttgcctttacctttatctaaaccataagcaagagccgccgctgtcggttcgttaataatacgtttgacttcaagaccggcaatacgtccggcatcttttgttgcttggcgttgtgcgtcattaaaataagccggcactgtgattacagcttccgttactgtttcacctaaaaaatcttccgcagtttttttcatttttttcaacacttcagctgaaatttgcggaggtgccattttttcaccttttaccgatacccaagcatcgccgttatcggctttagtgatttcaaaaggcataatagcaacgtcacgttgtacttcttgatcttcaaagcgacgaccaattaaacgtttgatcgcaaataatgtatttttcgggttcgtcacagcctgacgtttcgctggttgtcctactaaggtttcattatcatttgtataagcaataatggatggggttgtgcgttcgccttcagcgttttcaatgacacgtggtttgtcgccgtccattacagccacacaagagtttgttgttcctaagtcaataccgataatttttcccataatatgttttctcctagtatctagtataaattcgttgacagtttcaagattgggataatgattgcaatttcaagtgcatggaatgcaaaattttgaaagtgcggtcattttttgccttgttccgtaaaatgtgattggaaatgaaaaattcaagaggaaaaatgaaattttatgtaaattaagttaaattttgttcaataaattgctgtttttttatttgaatcgcaatttctctccgacgatccagttctactcgaattgctttatgttgaaagccttctgaaataatctgttgcacattaacagctaaagctgcttggtagaggcacaacaaaaatttgtattgtgggcaatcggtatagttcatttcggtttgagtcagactatcagcaaggcaaactaacattaattcttcgaagcgttttggtttacgccagacatctaacttattaaataacgttaagattgttttggtgtgcaatgccaaagcatgatgaatatgagaatgatattggcaagttaattctgccagttcttgaacatagttagggactttaaaacgctgacagacatttctgagataagcaatacttgttattttattatcatgagaataaggggggatattggcggttgagagagcttttcccacatcatgacaaagtgcagcaaaacgtaccgcacttttgtgataatccgttttttcggttaacaatgttgtttgcttaagaatgggcatagcatgcacaaaatcagtcatgtctgagcgatattgtatagagtcggaattaaacacactaatttccggacataaaacttttagggcatctattttttgtaagatagcaaaataaacttgtggatcctgttcatgtagtgctttttctgtttcttgccacactctttccggagaaagttgtctcaactctccattattggctatttttttcattaaggctagcgtatctggtgcaattttaaagcctaattgatgataacgggcggcaaagcgagctactctgagaactcgtaagggatcttctgcaaaagccggcgaaatatgacgtaaaataccttttttcaaatcggcaataccattgtatggatcatgatattgccccgccatatcctgagcaatggcattaatggttaaatcacgacgcatcagatcttgttctaatgtaatattagggttgaaatcacaaataaaaccagtatagccggtacctgatttccgttctgttcgtgcaagtgcatattcttctcttgttttaggatttaagaaaacaggaaagtctttaccaacttgttgataaccctgagagagtaaatcttcagctgttgacccgaccacaagccaatcacgatctttaataggtaagccaagtaattgatctcgaacagcaccgccaacaagataaatttgcatcatatcgttaagaccaacgattttggcgacggcgtttcggaattagtagaggtaaaataagaccaagcaataatcctgcacctaaaacagagccaccgtagataaaccactgaatagcgatttctcgtttacccacatctaacatcgcttctaaatcacgatttttattttttgtaatttccaattccctattaaggagtgagttttgttccagtaatttgttgctttgttcttctgcttgtttggtacggcgttgcatctcgattgttcgttgtttccagtcattgtcaatattattgagctttagagttaactcttggatttgagcttttaattttggattttcttccctgctacttggagtactggttaattcacttgttaaaatccatgcttcacgattacgtttgtcacgaattaaggaatatttatcttttttatccagtacggtaaccgactcgcctgcttgaatagttcccgaaattttaaattgatctcctgcacctcgtcgcataaacgttgtgagattttctttcacgtattttgtttcggcataagcgttggataaggaaaatactaatagaagagcggatactaaaagagaggtaatttttttcataataaatccagaaaataaggtcaacaaaaaagtaataaaaagtgcggtagattttaccgcacttttttttgctgacaagtaatgatttattttatctttgagcgttaatgaaaaatcgcataaataatgtaataaatcacaatagcaaagaaagtacccgcaggtaatgtaacaatccaagaagcaacaatattacgaataacggttaagttaattgctgcaataccacgtgcaaaaccaatacctaaaatagcaccaacaagtgtttgagtcgttgatataggtaatccggttcctgatgctaagacaactgttacagcagtagcaaattgggcagcgaaaccacgacttggcgtgaggtctgtaatgcctgtcccgatcgttgacattactttataacccataacaattaaacctactccaatgccgacagagccaagaggcaggatccaccaagccagggtagtttttcctgcaatctcaccaccatgttctatgatggaaacaacggcggacaaaggacccactgcgttggcaacgtcatttgaaccatgagcaaatgccattgcacaggcagttaatagcattaaaatactaaatactttttcaactgctccaaaggttcctttcgtaacattttgaatgaaacgttggctacgaaaataaaaagaaccaagaatacccgcaataatactaatgataccggatataatcagtgtttctatggtagttaaatgtaatccaatatgttttagccctttcgtcatagttacaatagctaaaataagaacggtcagtcccatataaaaaggtccgtatttttgggcattagctaaaggttttggcgtgtcaaagattaacttttgtgtactaaagaaaatagcgtaagcaataattccggcgagaataggggtgataaaccaacttcccacaatattgcgtacagttccccaatcaaccgcatgtgcaccgacagtaatacaagcaaaaccgacaattgcaccgataattgcatgagttgtagaaaccggccaacccatttttgaggcaattaataaccaaatccccgatgaaaaaagagctgccatcataccgaaaaccaaaatttccggagtatcagtaaactgcattggatctataacgccgcttttaatcgtttctgttacttctcctcctgcgaggtaagctcccgcacattcaaaaaacatcgcaataaaaattgcttgttttgctgtaatagtacctgaacctactgatgtccccatggcatttgctacatcattagcacccacaccaaatgccatcaaaaaaccgaaaacggcggtaataataacaagtatagttccgtattcttgtaaaatttccatagttgatcactcctatgtatttatcgttatgaacgagctaacattaattcaattcgtgaacccacacgttgtgcttgatcagctaaaaccccaatccatgctaaagtttcatataaaaacatcacatcaataggactgtactgattttctatgtttcggagcatcatgcgaagtttgatttgcatatgatctgtatcatcttcaatggcatccaactcatggattaggttattgacgagagtcagttcatgtcctttaaatccggtttccaataacgcatccatttcctcgatcacacgatttgcttgaactgtcgcatctaaactacgataaacatatttcataaaatcctcttgcatttcttgaggaaaggtaaattggcgaccgagcattctcccggctatatctttggcacaattcgctaatttatcttgttgagttgtcaactctaataaatctgtacgatcaattggcataaaaagacctaaagggagcttcaagcgaatttcacgtttcagtgtgtcggcttgacgttcaagttctgagagctcagcacggatctttgtggcattatgccaatctccggcaaaggtactttcaaagaaaggaatgagcagtttacaacattcagttactttatcagaatgacgctgtaatggcgttagaggtgaatgggcaaataatcctagaatattattcattgccatatgaattaaactccttagtggatttgataaaaaattcaggcgcatattaccttatgcgaacagaaaaatatagaaatttcatcgaaaaaaataggtttttagtagataatacaggcacgcatttcttagcaaggaaaggaaaatgaccaaggaaatagagcttaaattgagtgtatcaaatgcctttgctcaatttttaagtcaagaaatgacaagttttcatgtgttaaaacaagagaaggtttttttaggcaatacctattatgatacagcggacagttattttgctcggcacaaaatgggcttgcgtgttcgtcaatataataatgattttactttaaccttgaaaacaaacggtgatgtgctgggtgggttacattctcgccctgaatacaatgtatctcaagaaagtgcggtgccaaatttggcgaaattaacagaaatatatgacttaccgaattggcatgaatttgtcttacagcctattttcagcactgattttgagcgttgtttatggttggtagaatgcgggtatgatgtggaaattgaagtggctttagatcaaggctggattattgcaggagaaaaatccgttcctatttgtgaagtggaatttgaattaaagcagggaaaaacagaggatttgttaaattttgtggcaaatttatctttagaaagtgatgttcgcttaagttcagccagcaaggcacagcgaggttaccaattggcatttaatatacaacctcaagttcaggattggatcgcaaaatggcgtgagtttattgtcttagcaacacatgaaaagatcgcttatttagtaaaatttgaacagcaattaatcgaagaaagtgtgatgctgggaaaagattattttgcacaagaatttttgcgtacagtggagcgaatcggtgcattttttaatctatatcacttttatagtgagaacgtaacgttattggaaaatcaagtaaatcttcaattgacgcaaggcattactcatttggatcagaatttgcttgctgatcttgttgaacgtaatgcttatttattgttgcaaattaaagacattattcggtgtcatagtgaaaataaaaataatgcacttgcgattgaaaaattatttgcattatttcatagcggtcagtatgtcaaacgtatgttagatttaacgtttttaacactctaaggatacagcatggcaaaatcacccaaaacagcctacgtgtgtaatgactgcggtgcggagtttgcccgttggcaaggacagtgttctgcatgtaaagcatggaatacgattagcgaagtgcggttagtttctacagcaaaagtgaaaaatgatcgttttagcggatatgcaggagaaacgaaagccaaaattcaaactttagctgaaatcagtttgcaagaaacgcctcgttttaccagtggttttagagaattagatcgtgtattggggggcggaattgtgccgggtagtgcgattttaatcggtgggcatcccggtgcaggaaaaagtaccctactgttacaagtgatgtgtggacttgctcaaagtatgaccgcactttatatcacgggcgaagaaagccttcaacaagttgctatgcgagctaatcgtttaggattgccaacggatcgtttgcaactcctatctgaaacctcaattgaacaaatttgtcatcttgctgatcaactaaagccgcaaattatcgttattgactctattcaggtaatgcatttatctgatattcaatcttcccccggaagtgtagctcaagtgcgtgaatgtgcagcatttttgacccgttatgctaagacaaggcaagttgccattatcatggtcggtcatgtaacgaaagatggaacgttggcagggccaaaggtattagaacatgcaattgatgcatctttattgttagaaggcgaatccgattcacgctatcgcactttgcgtagtcataagaatcgttttggtgcggtgaatgaattgggtgtttttgcgatgacagagcaaggtttgagagaggttaaaaatccttctgcgatttttttaagtcgtggtgatgaacaaacgtcaggaagttccgtgatggtagtatgggaaggaactcgtcctttattagttgaaattcaagcacttgttgatcattccatgttagccaatccaagacgtgttgcagtaggtttagaacataatcgattagcattgcttctagcggtattacatcgtcatggcggtttacaaatgtccgatcaagatatttttgttaatgttgttggcggggtaaaagtaacggaaaccagtgccgatcttgccttattgctggcattaatttccagctttcgtaatcgacctttgccacaagatttagtcgtgttcggcgaggtaggtttagcgggggaaattcgccctgtaccaagtggacaggaacgtattagtgaagcagcaaagcacggttttaagcgagctattgttccctttgcaaataaaccgaaaagtgcggtcgaaaatatgcaagtttttacagtcaagaaattagcggatgcgttggcgatattagataatttttaacaaaattgctggataaaaacgaataaatatctaaaaaatagtgtaaaattagacaaaaataaatattttatgcggaatttctatataaaaagggatgaataatggaaaagaagattaaatcacttgatagtattgatataaaaattcttaatgaattacaacgcaacggaaaaatttctaatattgatttatccaaaaaagtgggattatcgccgacgccttgtttggagcgggtaaaacgtttagaacgccaaggcattattatggggtatcgtgctttattaaaccctgaattattggattcgcctttgttggttattgtggaaattacattagttcgtggtcgtcccgacgtgtttgaggaatttaatgtggcagtgcaacaattagatgaaattcaggaatgtcacttggtttccggagattttgattatttgttgaaaactcgtgtagcggatatggcagcgtatcgcaaattgctcggcacaactttattacgtttaccgggggtaaatgacacacggacttatgtagtgatggaagaagttaaacaaactaattttttacaattgaaataagatgattaaacgtattaaacaattttttttaccgaaaagggatttagtcgagtttttattaattctcaccgcactttggggcttttatttgatcgttgcttggtttagctatagcccgtttgataattcgtgggcgatatcttcttttcaaacggaaactattaataaagcaggtgcattgggtgcttggatgattgatctgtttttcacgttttttggcgtggtaggtaatatcataccttttgtactatttatcgcacctatttattttttacatactaagcgaactcaagggttaacttggggaagattttttcttcggatattgggttttgtgacattgctggttggtttaatgatcttggctactttaatgttggcaaaaactgaacatcatttatcgggcggtgtattaggtgctattttaatcgttaagttatatccgctattttctaaccaatttcccttaattattattggtagcattgcttctataatcggttttattttctgttcgggggcatctttattttatttaatgatgaattgttacgactggctgacaatgaaagataaagaatctctattggatacacaatcgaatggtgctgattcagttgaacaggaattggaagaaattatcatacaatcgccacctatagaacaaaatatcgccaatgaagatactgaaaaacaaggacttgagttagttaatattagtagttttattaatattcaagggttacctgatgaacaagtggaagaacagcaaaatttagcagctccgatgttgatgaagcaaaatgaagtggttgatattgctcaaacactaggcgatttaaagcaacaagaattgcctattccaagcgtttcattgtcaacagaaaaaaatgaagcgttagctttggaaacagaaaatattgtagaacagaccgcactttctgccgttgaggaagctgacaatcacaatataaatgaacttgccaaacaatttgctgaatttgagcaacaacgtttattgaaaatggaacaacaggcaagagaaatcggagcagaggatgcgttaaaagtgattttagctgaagaagttactgaagacgtgccggcggttataaaagaagttgttgaagaaaaagagctcagtcaaagtgcggttaattataagacttatggcgatagtttgattcaccccgcattacagcagaaagtgactgttcaggaaaaaccgacaacaccattgccaagtttagatttacttgaacgccgaacgatccaaacttataacattacccaagaggaaattttagaaacatctcaacgtattatgcaacagttacgtaattttaatgtaaaagcggaagtgcgtgatgtactcgttggtcctgtggtaacacgttatgaattagaattacagccgggagtaaaagcctcaaaagtgacaagtattgatactgatttagcaagggctttaatgttccgttcaattcgtattgccgaagtgattccgggaaaaccttatattggaattgaaacaccgaatatacatcgtcaaattgtacctttgcgtgatgtattggatacggatgagtttcggcaatcaaattatttattaccaatggcgttaggcaaggatattagcggtaagcctgtgattgtagatttagcgaaaatgccacatttattagttgcaggatctaccggttcgggtaagtctgtcggtgtgaataccatgattttaagtttacttttccgtgttaaaccggaagaggttaaatttattatgattgatcctaaagtagtggaattatctgtctataacggcattcctcatttacttacggaggttgttacggatatgaaaaaagcagctaatgccttgcgttggtgtgttgacgaaatggaacgtcgctaccaattgttatcagccttaagagtacgcaatattgagggatataacgaaaaaattgcagaatacgaagcattaaatatgcctattccaaatccactttggagaccgggtgatacgatggatactttacctcctccattggaaaaattaagttatatcgtacttattgttgatgagtttgcagacttaatgatggttgcgggtaaacaggttgaagaacttattgctcgtctagcacaaaaagcacgagctattggtattcatctgattttggctacacaacgtccatcagtagatgtgattaccggtttaattaaagccaatattccaagtcgtattgcttttactgtagcgagtaaaattgattcaagaactattttggatcaaggtggtgcagaggcattattaggacgtggtgatatgctgtattctgcacaaggatcatctgagttgttacgtgtacatggtgcttttatgagcgatgatgaagttgtacgtgttgctgatgattggcgtgctagaggcaaaccgaattatattgaaggtattttggacagcgtaaatgacgaaagtaacgataatgaaactgactatgacagcaatggtgatctggatgacttatttgatgaagttgtggaatttgtcataaacactggcatcacttcggcttcttcagttcaacgtcgtttccgagttggctttaaccgagcagctcgcatcatggatcaactggaagaacaaggtatcgtttctccgctacaaaatggtaagcgggaagtattatcgaggaaaggggattactaaattaatattgcgatataatttgtgcaaaaaaccaccgcacttaattagtgcggtggttttttctttgggtgtagcaagttagctaaattaccattgataccccacaccaaccgaaccgccgacatcgcccgttgaactgcgagtaccttgcaatcgtagcgttattttaccattatcacttactcgtgaataacctaacgccagtgcattttgtcctttaaatgttccggcagatgccgcaaacatggatttacccggcacagaagacatcggcaacccagccgctgccaacgctcctgcaattcctgcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcacgggtttcaaaagaggtcatgtttttcaattggtcggacagtttgacttctaagcctttaccgtcttgagacatttccactttgatattaccggcagcagtgcggtcgctgttaaatttattgccattcgcaccttcttcacctttaatcgcaaaagtaccgcttaatgctgtgtgaatttccatgtcatcattgcctttaaatttcaagcccgatttcgctaccgcctgcaaatcaccgattgttgcygcgttggttaaatcyaytktrctwtctkgtttcactarctctgcaacttttkcatagccyyyrtaattwktytcatassctttattsgcttctgttaagcctttttgagcatctgccaaatcagtttttgctgtttcaagtgcttttttcgcttcatcaagtttcatttgattttcttttagcttagcttctgcttgcgttttatcctcgcccgctggcaacgcatttatcgcctgttctaagctacttaccgctaacgctaaatccgtgaaagtttgtgctttgtccgaaagtgctttagctttctcacccaccgcttttactttttcctcaacagctttggtgagttcagtcgctttttcttgagtctttttcttctcttcttcggtttgtgcttctaagccaagaccacttgccacattgctaatacctatcggcgtggcggtcggctcggctttgatcacgacttgtttcttctcttnnnnnnnnnnnnnnnnnnnnnnnnnnnnnnnnnnnnnnnnnnnnnnnnnnnnnnnnnctttcacgactttttcattgcctagataaaaatcaaatggacggttattgttcagatttttaacctgttcatcgacatagtttttatttaccgcactagtgccgtcagctccattttctaaatcttttagaccggtgatttttcctgagccgatttttttaccgtcagtaccttttgtggagaatgcaatagacggttcttgatctttctcaaacgattctagactgtctttatttaccggttttgcacctgctttaatagtgattgatggtgagtcagcaaatggatctgctccacttgctccgtttgcaccattcgccccttgtggggtaagtgcaataccgtctttgtcaatttgtactttcgcccccgttgtgccaacttggaatgtggcattttctgaagttaaagaaagtttggtgacttctccagttgaattggcaccatttccggccgcacttcctttaggtgaagaaattgattttatattttnnnnnnnnnnnnnnnnnnnnnnnnnnnnnnnnnnnnnnnnnnnnnnnnttggtgtaccagtcgttgttgtactcgtggttggtgttgtagttgtgctacttgccgaagcagacgacggagcagctgccggagcaggcgacggtgctggagcagctggtgttggagccggtgcggaagcagaagcactcgcacttgcttgtgttgcactatcatttccatcttttacagttacttggatattctgtccgttcgtaaacttcaaagtgtcgnnnnnnnnnnnnnnnnnnnnnttaccatcaccattttcaaccttaaacttaaagctacttaacgcttcttcaagataggatttggtaatcaagtcattttctccaactgtacttccgcttgcaccacttccgctacctgtgccattctcatacatttgtttttgagaaagcgtaaccttttcaaatatcggtgcatttttaaagccgatttcgattttggcgttgccnnnnnnnnnnnnnnnnnnnnnnnnnnnnnnnnnnnnnnnnnnnnnnnnnnnnnnnnnnnnnnnnnnnnnnnnnnnnnnnggagctagtgtagcagacgaaccagcctgattcatatctaaacgcacaatgctaagggtcgaaccaagatagtgcggtgtgttttgagtgccatttgttaccgcactttgatccgctctgaacatcaagcccttgttaatagccgtaatgctttcattaatagcttctctaaaggttgttggggcttttatttgtccttgctgtgttccttgctgtgttccttgnnnnnnnnnnnnnnnnnnnnnnnnnnnnnnnnnnnnnnnnnnnnnnnnnnnnnnnnnnnnnnntttctctgcaccaagtacatcaaaaccgagtttannnnnnnnnnnnnnnnnnnnnnnnnnntgtccaccgttaatcgcatcagttgagccggtwtcgactttacctgcggcaacgttggtgataatccgctcgctacccttatcccctacgctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcactttgtgctttggactcagaacccctaccaatcaccacggaattttctgcactttctgctttggcaccgttaccgaatacgagtacgctatcattattacttcccgttacctcaatattcgaccccaacgccacaatgtcattaccgttcgtaattttggtgttattaccgatagccactgcccattcggcattggtgattttcgtatccctacccacaccgatggattgtagtgcattttttaactctactccatttcctatagcgatgacagaatcgttactcttaccattatcttttgaaatggtaatattcgaccccaaggcgacaatatcatttccgcctgaaacgttgtttttattaccgatggagattgcccattcggcgttttgtaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcccttgttaatggtttcaatgcttttctcaatggcttctttgaatgtcgttggtgctggagatgtctcacttccattttcatttttcaacttggtaaatgtggttgctttgaatgtttttgaacttttatccacttctgcaccnnnnnnnnnnnnnnnnnnnnnnnnnnnnnnnnnnnnnnnnnnnnnnnnnnnnnnnnnnnnnnnnncatcggttgagttaggcattacacttccagcagcaacatgtttaattatgcgttcattgccttgactacccacactgacaacttctttatccgcccctgctcctgcattgttccagtcaaatttcaaacttgctgaacccacattaatatctgcactggtcgcagcggtagttttcccttcccatgtagaatttttacccaacgcaaaggaattatcgccgttggtagacccattgccgacattgattatcgctaatttattggttactttatccgtcaaagaaaacacaatttctttaccgctaccatttgaagaagccttgctggttaaatacgttccatcacccttaatcgtgattttatcgccgagtgcggcgttaatatcgctacctgtatttccagcaaaagttaagcctttttgaacaatcgctttagcgacttcggacaggtcttttacattgacggcgttgttggcaattgtaccgctattgccaccgctagtcgcaccatcagggtttcctgagaggactttttcaataatgccggcatttccgtttccgctacttccaccagcaccatttaaccctaaaccgctcgctaagttagtgagttttttgttatttaaatctaaaccgctgtcactaaaggtatagcttgctttattggtacccactttaatggaggcaccagcattgtctacgacaatgcttgaaccgtctttcgtgctttctaaggtagctttaccgtcctcaagttttaatgctgctttgtcgtttcctttactaatttcagacacgccactaaatttaccatcggctagggtaacctctgaactacctgccttgaaagtaattttgttatcacttccattacttccacccaaagcaattttcgcattctcgccattggcaatagacgcaataccttttaagtttttagacaatttaatttctagggtatctgctttgccatttgtaccgtttttcttcgccacgataatattatcaggtgcggttgtaatttgagttgttgcagttgttcctgatgctgaaattgctgtttctccaactattttcaacgtctcaccgagtttgcgagtaacttctttattgtcatttccttggaacttcaagcctttttccacaagggctttcgccacttcggacaagtcttttacattgatggcgttgttggaaattttgttgccgttgttattacctttatcaggattgccagcaagaacgttggcaataactgtactattatttccggcatttccaccagtaccgctagtatctgtcaatcctaaaccgctcgcaagtgcggtgatttttttattaccaacatggaatccttgtggatcaaaggtatattttgccccatttgaactgataaccacattagtatttcttttgttgcctttaccattttcattaaacttaatttcagtttttactttactgtttccgctaccgccattggcgacctctttactagcaatcgaagtaatattagttaatgcgtcattgacattaaacttaacaactccgttttcttccacttctgcggtggtgtttgtgccatttttaaaattcaaaccatcgcttaatttgacggtataatcacccgaaccattcgccttgtatttaatgacttggtcggtaatttttccctctatactggtttttactgctgtaatctctttctcgtttttatccgctttagtagccgtgtcctcaatttttttcgtgattttctcatctagcccaattttgatcgtatcttcaccctcaacagaggttttaatttgattagcagtgcctttcactttcaaagtacccgtttttaatgaaaaggtcttttcaccaccactgtctgcttggaattttaagttagagctgagattattaactttatcatcaacatattttttagtggtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcactaaaaataaaacccatattaattttatcaatattatcatctatcgcttgtttaaatgttttttgtatagctggtgttgaagcagtggctccgttagaacctattaattgattgaatgttgatttcgtaaatccacctgaatttactgtcgcacccaatacagttgttgctaactcttgtaattgtccaaagttggcagcatctttgtcggctattccttttgctaactgggtaatttttttgytrcctaartccaagccatckctttttaakgttatcgttgaaccgctttttgacgagagtttaagaccatcactgttcgtaaagtcaattttattgccactattgccatttttaccggyaatmgargwaatmcctgttaaagystctttragcgawatkktwacckcaytrccgctagcgtttgtcttgatattgccattatctcctttaatatccagtttgctagttactttaaakgttccgttatymccayttacattaaaactngtagcaacatttttgaatttatcatcaacgtattttttgttgacggcatgcttgtcatctgtagggttaccggtaagttttacagtcttaaattcaggatcgtcttttaagccgatagtaaatgttggttttgaactatcgtttttaaattctgtttttaggtttttacccagatgtgtggctttaccgccggattgaatatttccagctttgattacaatggttgaacctaaataaaaaggtgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccaatatattcaacagcggtaaaattatgactattaaattctgttttagcattgttagccgtcaaccctaagatactaccaccaagctgattcagctgattccctgtaatcgcttgatccgagttttgtgcaattttgccgtcttttaaattgccgaattgtattttgttcccaagatctttggygcctattttttcatcgaaaccttttgctccgactaatactttgtcctcggaaattgcctgagaatcttttaacggttcgcctgtttgggtatcgactttgtagaattttttgtcatcagccgattttactagcttcactttcttgccgccttcttcggtgtagtaaacaacaagtccttcttttttaacataatataacgctcttagttgtcctacagtggcggcatcactatccaacgcgcccggtgcgacattcactattctacgcaatccaacatgatttttatttcctttagatgaaccgggaccgccctttgcatcttttgttgtatcccaacccccaacggaaataacccctgccgatgtatccgtttcaattctataactggaaccttccggtacatatccttctaaattggaggcattgtaggcatttttttcatttaaactggctgttgttttatctgtatcagtataaaagtaattcgtcgttgatctatatcctaaggcgactgaattttcggatgatgagcttgaattattccccaatgcgactgagtttttagcattttcattaatcttagaatcattccctagtgccatagaggattctgaaagagaagacgaaccatatcctatggcaattgaattatctttcttaatcccaactccggatcctatcccaattgctctcgcacctatgacggttacccccgttcctattgcaaccgagttttctttatgtacgtttgttcccacacctatggctattgtattggttgcatattttccaacattatttaacgcccctaagacgaccgaattagctccccttacataagaggcactacctatggctatggtattatctccattatttgaaatgtgataacccaaggatattgcatgatctccttgttttttcgttttctttatatcttctgttgtggtgatttctacatgattttctttttcatatgtaaatttattttctttttcaagtttagttatcaagtcgcttattttattctgtccattaaaatgattggcaggaaatccatacttaacaatttcattgtgatctcccactttaagatcattaatatcagtagttacagttttcaaccaaggatcttgattttcagtcacattaccaaggttggtttcttgcataatttgagctctgaatttctcagctgatgtatgcgttaattctgcattcgaagacacattaggtcctatcgctattgaacccattcccactgcttttgctccggaaccaaaggataatgatccttctgcggttgattcagccgcatttcctatggcataagaatttttcgcaaaaacccttgatgagtcacctattgctgttgctccgtcagcacctaaaccgacaaacgcacgaacaccgaccgccgttgctctatcggctaatgcaaatgataacgtccccatagccagtgaagcatttccatatccaactgatcttgaccctattgcgattgcccccactccggctgcataggttggggaatatattctgtgatcttcaccagaatctgacctaatatattttttgtaaaaatcattccaatttactaaatccttataagtaacattactagatgctctatttccattatatccataaattagttttatagtctcttcaggtagcctatcttcaaatcccccaagtcctgctttaatattatttgctccaaaggtaccttttttcccatttgcaaatatatcatcactacctattgcgatagatgattctccagccgccatgacgtccgcacctaaggctgtcccttgtgctgctgcataaacattatttcctattgccgttgcttgagcactttgagctttacttcctttccctacagctgttccattggttcctgctactgcagcttcatagcctacggctgttgctccatctcgaagtgcttgagctccgtatcctacagcaaccagtccttctcctgttgctttagttttatctcctgcccctattactacaactttttccaacttggtgacttgtccacttactctatgtagtttttttttccctaacacaatattaccattattattattttctccatattcatggtcccaacttgctatacctacagttcctttactttcattaatagctaaccaagcagcatttgatatagtactcacccctaaaaagcctgctatcataaaagccaacggtaaaaccttaaacgttcgtaaaagcccaccgcactttggtttctccgagctgctcgccacttggcgattgcttgccaactcggaaacggctttacattgacctgttgtaatatcgtatttggttttaaatattttgttcatagaattactcgctttaaaaattatctttgaatgacttgttaaatggttattgatcgaatctgttattgattgtttatttattatctcttactgattatttattaaactttagagagaggggataaccctaaataggcaataccttgctttttaaggcatagcagaaaaaggcgaatgatattttcgcaaaggggtttaaaaggggaaatttgggtatgacgagaagttaaaaaatttttaaaatttattttgcaaggtttataaaaaggcgttagcctaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcatattgttttcgtctatcaaatggttaagtaataaatttgggcgattttatcccaaatttattagtaagggaatgatttcgtgtattttatttgtattttacacttgttgttgattgtttacgatttgcaaccatgatttccacaacaaccgtgatgttcatggtgttcatgatgatgtccgccacatccacaatgatgaccctcttcatcattatcatgtgtacaacaaccgccctctgtatgaatatgaccatgtgccatttcttccagtgttgcttcacgcgttgcaatgacctctacggaaaaatgcaattcttgaccggcaagcatatggttaccatcaactaccacctcattttcatttacttcagtgataacaacaggtaatggcccaagatccgtatctgcgataaaacgcataccgactaccagctcatcaacgcccacaaaaatatctttgggtacacgttgcaccatgttttcattatattctccgtacccttcttccggttttacacgcacttcgaatttatcaccgacagatttaccttccagtgcattctccagtccgatcacgaggttctgatgtccatgtaaatattctaaaggttgatttgccggtgcttcatcaaccaatacgccgtcttcagtgcgtacttggtaagcgatacttaccacaacatttttttctactttcatttttattcctttatgctgtaaaagtgcggtcattttagccaaaatattggctattgtcattcatcttcatttggatattcgtcaaaaaattctccgtcattaccatattcatcttctgttgcattcggatcttcgaagtaagtaccccatccgtcataaatgccaccgaattttgtgattaatggcaataagtctttttgttgtgcatcaatgatttctgcttttaaattaacttcactaatgatgtcaaagcagaaaatagatttaccttgttcatcttcaaattcttccgcttcagaaacttcatagcctgctttgaaagcatcaacggcgattttttctaacttatcaaaatcgtcatgtgcgatatgatgttcaataatatataaagcatcaggatcactaccgtcattgagtaaatcagtaataatttttctagtttcttcttggagatctacaagtgcagtcatattttttcctttatgtttatttagggagtggggataaattcattgcgttgatataatttaattgtcgccatgcttcatagacggtaaccgcaacagcattggataaattcatgctacggctattttctatcattggaatacgaattttttgtgttgtcggtaagttatctaaaattgacattgggatacctctagtttccggaccgaacataagataatcgcccaactcaaaatttacttggctatgtgcaggtgtaccttttgttgtgagtgcaaaaagacggttaggttgttctgtgtttagaaattcattaaaagttttatgctttttgatttgtgcaaattcatgataatccaaacctgaacggcgtaattttttatcgtcccaagtaaatcctaagggttcgattaaatgtaaacgaaaacccgtattggcacataggcgaataatatttcccgtattttggggaatttccggttcatacagtacgatgtctaacataacaaaatcctcgtttatgcaacatggggaattttactcttttatcaactaatcacaaaattattcctaccgtttccttcaaaaaatacttctaagcaaacagaaagtgcggtctaaatgtgcataaaaaaggcggagaactctccgcctttcatgatggaaaatatattattaagctttaggaccagctgcgatgagtgcttttccttcttcatttgtagcatatttttcaaagtttttcacgaaacgacttgcaaggtcttccgcttttgcttgccattgtgctttatccgcataagtatcacgaggatctaagattgcaggatctacacccggcaatgcttttggaatagctaaatcgaagattggtaatgaacccatttccgcactttcaattgagccgtctaagatagcgtcgataataccacgagtatctttaattgagatgcgtttacctgtaccgttccaacctgtattgactaagtacgcttcagcaccagaatctttcatacgttttaccaacacttctgcgtattgggttgggtgcaaacttaagaatgccgcaccgaaacaggcggagaatgttggcgtcggctcagtaatgccacgctctgtaccggctaattttgcagtgaaaccggataagaagtagtatttagtttgttcaggtgtgagttttgaaaccggaggtaagacaccgaacgcatctgccgttaagaagataacttttgttgcatgtcctgcttttgataccggtttaacaatattgtcaatgtggtaaattggataagatacacgagtattctccgtttttgaaccgtcatcaaagtcaacggaaccatcctcacgaacgacaacattttctaacaacgcatcacgtctgattgcacgataaatatcaggctcgctttctgcggaaagtttgattgtttttgcataacaaccaccttcatagttgaagacaccgtcatcatcccagccatgttcatcatcaccgattaattgacgtttcggatcggttgaaagcgttgttttacctgtaccggataggccgaagaaaatcgccacatcgccatctttgcctacgtttgcagaacagtgcattgaggcgataccttttaatggtaagaagtagttcatcattgagaacatcccttttttcatttcaccgccgtaccaagtaccgccgattaattgaacgccctcagtaatgttaaatgccacaaagttctctgaatttaatccttgctctttccaattcgggttagttactttagaaccgttcataaccgtaaagtccggtttgaaattttgcaattcttcatcagacggacgaataaacatattttttacaaaatgtgcctgccatgcgacttcagtaacaatacgcactgctaaacgtgtatcagggtttgctccgcaaaaagcgtcgataacaaacaaacgcttgccggaaagctgtttggtgaccaaccctttcaaactttgccaagtttcttggttcatcggcttattgtcgtttttcgccgcatcgctcgtccaccatactgtattttttgttttttcatctaaaacaatgtacttatcttttggcgaacgaccggtaaaaattcccgtatctaccgcaaccgcacctgaagtggtaacaacacctttctcgaagcccgctaaacccggtttggtttcttcttcaaaaagttgttcataactcggattatggacaatctcttttacatcatagatgcctaattcacctaattcatttattactttgtttaagtcagtcataaaacacctcatagttaaaagttaattttaaaagttaatcatttagtggtagatattatagtgaaaataagaaataaaaaatgttatcttgatctcaaaattgaaaaataaatgaaatgaatgttgagaattataaaaagcgatggttgaaccatcgctttgaattaagattaatatgattatggataaacaggaagacgtttgcaaattgctaatactttttctttagtatcagcaatgacttgttcatggttatctttattcatactgtctaaaatatcgcacatccaaccggcaagttccgccacatcttcttcgttgaagcctcgacgagttacagcaggtgttcccacacgaatacctgaggtaacgaacggtttttgcggatcattaggaaccgcatttttattaacagtaatattggcacgacttaacgccgcatcagccgctttaccggttaagccatgattgactaaatcaactaagaataaatggttttctgtaccgttagagacaacgttgtaaccacgttgtttaaaaacttttaccatagcttttgcattttttactacttgtgcttgataagttttgaactcaggttccaaagcttctttaaaacaaacggctttcgctgcaataacatgaactaacggtccgccttgtcctgccggaaataccgcactatttaattttttgtaaagttcttcattgccgttggcaagaattaaccctccacgaggccccgctaaggttttgtgtgttgtggtggtaactacatgagcatgtggcattgggcttggatatacaccggcggcaataagccctgcaacatgtgccatatcaacaaataaatatgcacctacttcatcggcaatttcacgcatttttgcccagtcaacgatttgagaataggcagaaaatccgccgacgatcatttttggtttcacttcatgagcctgtttacgcaacgcatcatagtcaatcagtccttcggatgtaataccgtattgctccgctttataaattttaccggagaaactgaccgaggcaccgtgagttaaatgtcccccatgagcaaggctcattcctaaaatggtgtcccccggatttaataatgccatataaaccgccgcatttgcttgtgagccggagtgcggttgaacgttagcataatctgcaccgaacaactcttttgcccgatcaatcgctaattgttcaacaatatctgcatattcacaaccgccataataacgtttacccggatagccttctgcatatttattggtgaattgacaaccttgtgcttccattactcgtgggctggcatagttttctgaggcaattagctcaatatgctcttcttgacgaagattttcatcttgaatggcttgccataaaaccggatcgtaatcggcaatattcatacttctttttaacattatgttttcctctttgctcacttatgaaatggtaacagtttacctgttttaacttaaaaatttaattaaaaattaattcctatttttcatcggtgtaatgaaaaaatttcattcataaataccgataagattgaccgcacttttattgattttctcttgctacggcacgataaccaatatcttgccgataaaaacgtccgctccattggatttgtttcgccaattttaatgcttgctgttgtgcggcaaaaacattttcacccatcgctgttacacaaagcacacgccctccattcgtcaataatcgctctcctttttgctcaactccggctaaaaaaactttttgattttcacccgcacttattggcaagccttgaatttcatcgcctttgcgatagttattcggatagccttctgcggctaaaacaataccaagtgccgcttgctcagaccattcagatttcacttgatccaatttaccctcgcaggcatttaaacaaagctcaaccaaatcagaccgcatacgcatcataatcggttgggtttcagggtcgccaaaacgacagttaaattcaattactttaggctgtccgtgtttatcaatcattaaaccggcatataaaaaacctgtataaatattgccttctttcgccatgccattcacggtaggataaatgatctgttgcataattcgcgtatgaatttccggtgtcactacaggtgccggagaatacgctcccattccccctgtattcggaccagtatcattttcgccaacacgtttatgatcttgtgaagtcgccatcggctctacatttttaccgtctaccataacaataaaactggcttcttcaccctctaaaaattcctcaatcactactttgctaccagctttgccaaaagcattaccggaaagcatatcttgaatagctttttccgcctcagccaacgtcattgcaacaatcacacctttgcctgtagccaaaccgtctgctttaacaacaatcggtgcatctttttcacgcacataagcaatcgctttttctgcatcagtaaaactgcggtattcagcagtaggaatatgatggcgagcaagaaaatctttcgtaaatgcctttgagccttctaattgagccgccgcttgagttggaccaaagatttttaaccctgatgctcgaaaagcatcgaccacaccaagcactaaaggtgcttcaggtcccacgatagtcaagccaatttgattttcttgtgcaaagttgaccagtgcatcaatatcagtagcggaaatagctacattttccaccgcacattttccgtctgtttccatagctgtccccgcattgccgggtgcaacaaatattttgcttgctaaaggtgattgtgcgactttccacaccaaagcatgttcacgtccaccatttccgataattaaaatattcattgtttttccttccttaactgttttttaggaataaagaaagcgggaggcgtattttccttaatatttaaataccctgaatctcccgttagaattgaatgattaattgtaccatccctacaatcagatatatccatatcataactcatgatgttaattaaaaatgtagccagttgctgatgaaacatttttttacaagatgaaaaatggttatgaaaaatatcttgtaaaaacttattttcagaataaataaaaataggcactaaataattagcttcatttaatgttccttgattatatacttcattagaaacaaactgtccgtgatcggaagtataaattaaaacccaatcttcaggttttaaagatgttttaagataattaaacactttttcaattaatttatccgtattatatatagtactatcatatttatctaaaggggtgttctctttgaaaactttttcttgctcagataaataataagcatagggtgtatgagatcctctttggtgtaaaacaacgaagtgcttcttacccccccccacctcacttaaatctatattttccagtaatggaaataagttatgatcatgcattccttcagaagatttatacccaaggctattaggaaaacgcaaatcatcgacccacgttttacccataagactcataatcatcatttgattttcaggttgtgaagaatagaaatatgtttcatatccctgctctttagctaagcggaataagttagttcttccgctaacaatttgttctaacccatttggttttggaatggcattaaacaatgatgggagagaaatagcagtccttgagcctgctgaatatgcaggttttaataatgtttcagtaggaaaattttttgataaagatgttaagaatggggtggtttctctctcataccccaatgcacttacattatttgcacttacactttctcccataatccaaataatattaggtatttggaatgagaatttaggtttcggcttcggcttatctttgtaataaaccgatacgttgctcaaattaaataaatcatagggtaaagttctacctataaaatatccaaaagaaaaataatttgctttaattcttgagtagcccggattggaagtaattcccagttcttgatcagaataaaaactacgaataaaaatataagccatacttaataggaataaaatatctgcaattaaatatgttttttttctaaatcttgaaatagaagaaaaaataagaatatcaaaaacaccccaaattatccctccggatattttatccaacatatgaataccggcatttgtaacttcccaatattctttaaacattaataaataatttgtaccattaatccagctttgatagacctcataatgaacattattaactaacgtactacaagaaaaaaataacaaaataataaaacgagttatcttatattttgagaaataaaataatgaaattaaaataaatattattagaaaactctcactaattttgtataaactatttattccaaaaaaatagcgataaagtatttcactaattaataaaacagcagaataactcaacaaaacaatgatatttttcatgaaaatccttatttattaatgtctaaaatgacgcattttagtgagtaccattaccatattatgctcattggcggcatcgataacttcttgatcacgcattgaaccgcccggatggattacgcattcaataccaacttttgcggctgcatcaatgccatcacggaacggaaagaaagcatccgatgccattacacagccttttacttccaaaccttcatcttttgctttgatccctgcaattttcgctgaataaacacggctcatttgtccggcaccaatccctacagtttgattatttttagcgtatacaatagcgttggatttcacaaattttgccactttccaacagaataaaagatcttccaactcttgtttggtcggttgacgtttactgactacttcaagatctgctaaatccaccatagataaatcagcctcttgtaccaacaaaccgccattgacacgtttaaaatccaagcgttgtattgcactttcccaattgccacacatcaataagcgaacatttttcttacttttcacaatttcttgggcggcggaactgacggtcggtgcaatgatcacttcaacgaattgccgctcaataatggcttttgccgtgtcttcatctaactcacgattaaatgcaataattccaccgaaagctgaggttggatccgtttggtaagctcgattataggcttcgagaatatccttgcccagtgctacaccgcaagggttagcatgcttaacaataacacaagccggctcggaaaaagatttcacacattcaagtgcggcatcagtgtcggcaatattattataagaaagtgctttaccttgtaactgtttagcggttgagacacttgcttcttttacgtcttgttctacatagaatgctgctttttgatgaccgttttcaccataacgcatagattgtttacgtataaaattaagatttaaagttcgtggaaattgaccgcacttcgcttcagcttcttcttcagctctgaaataaggttttaccatttgtccgaaataattggcgatcatgctgtcatattgtgcggtatgttcaaacgctttaatggctaaatcaaatcttgtctctaatgttaaactatttcgattttgatccatttcagcaagaattgcattaaaatcgccattattgactacaatagccacatgttgatgattttttgcggcagaacgtaccattgtcggaccgccaatatcaatgttttctactgcatcttcaagtgtgcaatcaggttttgctacagttgccgcaaaaggatataagttcactacaaccatatcaatagcatcaatttgatgttgcatcataacttcatcatctataccacggcgacctaaaatgcccccatgaattttaggatgcaaggtttttacacgtccctccatcatttcaggaaaacctgtataatcagatacttccgtaacaggaaccccgttttcagcgagtaattttgccgtcccccctgttgataatagttttacacctcgtttaactaaaccttgtgcaaattcaacaattcctgatttatctgaaacgctgagtaatgcttgacgaataggatgatttaattgcattgaatatttcctttattttaaccgacaaaaaacgcaggcattataacgcaaacgtttgctcttgtgtaaataaaaaagcctataattaagtacagaatgaatacatgtagcggtaaaattatttttccactgctttatatacgcactaaaataccctgacattttttgcaaaaatataccgcacttttttgttgaatgttgtgatgacgacgtgcggacaattgatgggtttgacattgacattgataagtaaacgttttgcctcttacattcgttacatcaaactgatgacacgtatccgccggaagctgaaaaatcttgttcatcacatgttgccattctgagccgtgaggttttacacgcccgaattgttgatacacaattaaatgtgccaactcatgaggaactacttgctgaataaattgttgcggattttccagcaataaagtgcggtttaattttatgctgttttgttgtaaataggcgacccctgctttcattcctcgcacatcataactgactgtcggcatcgcaaaattacattgaaaatattgttcagccagtattaagcaatctcttaaacgtctttggatttgcatttttatatgacgaaactcagctaaattttgttcagttttaggcataaagtgcggtcaattttgggtaagatttataaacaaaaggcgaactgttgagttcgcctcatatgagaaattaatcgttattttaaacttgcggcagcacgtaattcttctgcacgatccactttttcccaagggaattgttctcgtccaaaatgtccataagcggcggtttgacgataaataggttggattaaatccagcattttaattaagccataaggacgtaaatcaaaaaattcacgaatcagagcaaccagtaattcattggcaacttttcctgtaccaaaagtttccaccataatcgacgttggttccgctacaccgatagcataagaaagttgaatttcacaccgatcagccagccccgcagcaacaatatttttggcaacataacgagcggcataagctgccgaacgatccacttttgacggatctttacctgaaaatgcaccaccgccgtgtcttgccgctccaccgtaagtatctacaataattttacgtccagttaaaccgcaatctcccattggaccgccaataacaaaacgaccggttgggttgataaaatatttcgtctcttttgataaccattctgccggtaaaatcggtttaataatttcttccattaccccttcgtgaacagttttttgatcaacattatcagaatgctgagtggaaaggacaactgcgtcaattccgacgattctattatcttcgtatttcaacgtaacctgacttttggcatcgggacgcaaccaatctaatataccttttttacgcacttgtgcttgacgttccattaagcggtgagcataagtaatagcggcaggcattaaaacgtcggtttcattcgttgcatagccaaacataatcccttgatcaccggcaccttgatctaatggactttcacgatccactccctgattaatatcagaagattgtttaccaatggcatttaataccgcacatgaatgcccgtcaaagcctatgtccgaatgtttatagccaatatcgcaaattacttgacgtgttaagttctcaatatccacccaagcagaagttgtaatttcaccgccgactagagccatacctgtttttacataggtttcacaagctactcgagcttttggatcttgtctcaaaatctcatcaagtactgcatcggaaatttgatcggcaattttgtccggatgtccttccgatacagattcggaggtaaataaataagatgacatagattttccttaatggtagaaatttttattaatattttttttagatgttttaacgtctagacggctatattacgcttttttaattaaaaggcaagtcttaatttaggttgtataaagggacagattgtgaaacaatctgcaaattattcggcattgtgcggacaacaatattttcatttcaataatttaacaattctcaaaaaagaaaatatattggttagcacctacttcatgtcaaggttattaaaaattaacaattaattaaggtgaaggagagtgatcgatttcgatggatatcgccctaatgtaggtatcgtgatctgcaatgcagaaaggcaggtgctttgggcgaaaagatatggacaaaactcttggcagtttccacaaggtggcataaatgacaatgaaactgctgagcaggcgatgtatcgtgaattatatgaagaagccggtttaacaccgaaagatgtcgagattttatatgtttcaaaacactggctacgctataaattaccaaaacgcttacttcgtcatgataaccgaccaatttgtatcggacaaaaacaacgttggtttttattgcaattggtttctgatgaaaaaagaatcaatatgcagcacacaaaatcaccggaatttgatggttggcgttgggtcagtttttggtatccggtgaggcaagttgtcacatttaaaaaagatgtttaccgtaaggtaatgaaagagtttgcattgtttttatttgatacaaatttaaaatctcgactatctgtaccggaagaaaaaaaaatgttttcatcggttaagaaaaaacttattcacaaaaaaaatcataaatattcttcaaatcagtgagggggataaaatgttaaccttttttctcatttgtctaggtgtaggaacctttgcagggtttcttgctggattattcggtattggcggaggactcattattgttcctacgcttgtgtatttacttccgatggttggtgtgccggatcatctgctcatgtcaaccgcacttggtacgtctttcgctacaattgtcatcaccagtttttcttcagcacagcgtcattacaaacttggtaatgtagtttgggatgcagttaaaattctcattccaactctgatgttatcaacgtttgtttttaccggtattgtcagtcaattagataagagtttatccagtaaactctttgcagttttagtcgcttatatggcaataagaatggttatttccactaaaattcaaatcaaaaatactaaaaaactcactcctttatcgtcagttattggcggcgttttaattggtattgtgtccagcattgcaggcattggcggtggcggatttatcgtaccgtttttaaattctcggggtgtagatataaagaaagctattggatcttccgcagtttgcggcatgctattagggctatcgggggcactcagttttatgcgtagtggttggggcgttactgaaatgccggaatattcgcttggttatgtctatttacctgctgttttaggcattaccatcacctcattttttacgtcaaaaataggtgcaactacgacatccaaactgcctgtacctacattaaaacgctatttcgcaataatgctttgtgtgattgcacttaatatgctttttaaataaggaaatttaatgaatacattttttcaaatgccctatattgatcctgtcatgtttagcttaggacccgtcagtttacattggtatggtgttatgtatttgctcggttttggttttgcttattggctcggaatggctcgggcgaaaaaatcaaatggagtatggacatcagaacaattggaacaattattatacaacggatttcttggcgttattttaggcggaagaatcggtgatgtgttcttttacaacgttgataagttttttgctgatccactctacctatttcgtatttgggaaggtggaatgtctttccacggtggattaatcggcgtcattctcgcaatgatttggacatctcgtcgccaacgtcgctgtttttggcagaccgcagattttgtcgctcctttaattcctttcggtttaggcatgggaagaattggtaactttattaacagcgaattatggggaagagtaacagatgtaccttgggcaatcattccttacgcttcaaccacacctcgacatccatctcaactctatgaagcctttttagaaggtttcattttattaatcatcttaaatctctatattcgcaaaccacgcccaaccggttccgtagcaggattgtttttaatcggctatggtatcttccgtttcctagtggaatatgtacgagaaattgatcacaacgtaaataccattgatgaccttctcacacgagggcaattactctgtttaccaatgatattcggtggacttgccgtgatgatttggtcttattctcgttcaaaggcaaataaaagtgcggttaaaaaagggtaaatttttatgcgtcaatatttaaatttatgtcaacgtattattgatcaaggtcattgggtcgaaaacgaacgcacggaaaaacgttgcttaacggttattaacgccgatctcacctatgatgttgcaaacaaccaatttcctttaattacgactagaaaaagttactggaaagcggctatcgctgaatttttaggctatattcgaggctatgacaatgctgctgattttcgtaaattaggcactaaaacatgggacgcaaatgccaatgaaaatcaagcatggctcaataatccggtacgtaaaggtacagacgatatgggaagagtatatggcgtacaaggtcgtcgttggcggaaaccgaacggagaaactgtcgatcagctacgtaaaatcgtcaataacctgagcaaaggaattgatgatcgaggagagattttaacctttttcaatcccggtgaaattgatctgggttgcttacgtccttgcatgcacactcacacattttctttactgggcgatacactttatttaaccagttatcaacgttcatgtgatgttccgctgggactcaatttcaatcaaattcaagtattcacattcttagcattaatggcacaaattaccggcaaaaaagcgggacaagcctatcataaaattatcaatgcacatatttacgaagatcagtttgaattaatgcgtgatgtacagcttaaaagagagccttttccgcttcctcgattagaaattaatcctgatattaaaaccttggaagatttagaaacttgggtaacaatggacgacttcaaagtgattggctatcaatgccatgaggcgattaaataccccttctcagtttaaaaaataggaaaaacctcaacagtgcggtctgattttgatgaaaaaatgatgcgttatgccttatctctagcggataaggcggaggcattgggagaaattcctgtcggggcggttttagtggataaacaaggcgatattcttgcagaaggatggaacctatccattattcacaacgatcctaccgcacatgcagagattattgcattacgccaagccggacaaaaattacaaaattatcgtttacttgacacaaccctctatgtcacgctggagccttgtacgatgtgtgccggtgccattttacacagccgaatcgggcgtttagtgttcggtgcttatgactataaaacaggtgcggtcggctcacgctttcatttttttaatgattacaaaatgaaccatatgctggaaattacagggggcgtgttgcaagaagaatgtagccaaaaaataagtacattttttcaaaaacgtagaaaacaaaaaaagcatttaaagcccaactttaaacctttcctttaattcttgtaactgatctctaattgcagccgctttttcaaattctaaatcttgggcaaatttatacatctgttgctcaagttttttcacttgttgttgatagtccttaggcgaatttatcttttgataaagtgcggacgattccgccacagttttagcacgagcctttgttttacttttcgttatagcaccttgcccaatatccagtaattcgcccacttttttatttaaagcctgtggcacaacgcctttttccgcattgtatttcatttgtttttctcgccgacgatgagtttcatcaatcgctttttgcatagatttcgttatgctgtctgcgtataaaatcgcttttccgtttaaatttcgtgccgcacgaccgatagtctgaataagagaacgttcagaacgaagaaacccctctttatcggcatctaaaatcgcaactaaggaaacttccggaatatccaaaccctctcgcagtaagttaatcccaactaatacatcaaattcacctaaacgcaaatcacgaatgatttcaacacgttcaacggtatcaatatctgaatgtaaatagcgaacccgaataccatgttcttccaaataatccgtgagatcttccgccatacgtttggttaacgtggtgaccaaaactcgctcattttgctccgctcttttccttgcttccgataacaaatcatcaacttgaatcgctacaggacgtatctccacttccggatcgagtaaaccggtaggtctcacaacctgatcaataatttcatcgcccgatttttccaattcataaggccccggtgttgccgaaacgtagatagtctgcggtgctaaacgctcaaattcttcaaaacgtaatgggcgattatccaacgccgaaggcaaacgaaaaccgtattccacaagcgtttctttgcgtgaacggtcgccacgatacataccgcctatttgcggaacagtgacatggctttcatcaataattaacaaaccgtcacttggaatataatcaaataacgttggtggcggctccccctcatctcgccctgataaataacgtgagtaattttcaatccccgaacaatatcccaactcattcatcatctcaatatcaaattgagttcgctgagttaatcgttgttcctctacaaggcgattatttgccaacaaatattcacgacgtgcctgaagttccaacttaattttttcaatcgcctctaaaatacgttctcgaggtgtaacataatgcgttttaggataaatagtatagcgaggtatcgcaccaaaattcgctccagtcagtggatcaaataaactcaaacgctcaatttcatcatcaaataactcaatacgtactgcccgatcatcagattcagccggaaaaatatcaataatttctccccgcactctaaatgtccctcgttgaaaaacctgatcattgcgggtgtattgtaattctgccaatttcgccaaaatttggcgttgatcaacaatcgcaccatgttgcaaatgcaacatcattttcaaatagctatccggatcgcctaaaccgtaaatcgcagaaacagaagcgactacaatcgtatctcgtcgctcaagaaaagatttagtcgcagacaaacgcatttgctcaatttgatcattaatcgaagcatctttttcaataaacgtatcactactcggcacataagcttccggctgataataatcataataagacacaaaatattccaccgcattttccggaaaaaaagccttcatttccgcataaagttgagcagccaaagttttattaggagccaacaccatagcaggacgattcaatttcgcaatgacattggcaatcgtaaaggttttacctgatccggtaacgccaagcaatgtttgatgtgctaacccatcattcagattctccgctaattttgcaatagcttgtggctgatcaccggcgggttgaaagtcggaatgtaaaataaaaggcttactgttaattttgctcatagcaacaaaaatactaaaaaagggcggtgcattctagcataaaaaaacgtttctttactgacaaaaataggataagataacccgaatttttacttgacaaataaaatagaacagaaaaaatgacagtctacagtctacagtctacagtctacagtctacagtctacagtctacagtctacagtctacagtctagtatgttgcctaaaatcaacctttcaagttaaatttgagaggttggacatgttcaaacaatatcttaaaaatcacctatttcaacctcaacctttcggcgaagataccattcgcctttttttgttgtgtcttaaaaagcaaggcatttcctgtttaggtttataaccaactcctaaaaagtttactaaacaatcaatcaaaatcaacgcaagaaataattaatttaaaaaatccatttttaaagagaatagagatatgaacaaaatattcaaaaccaaatacgatattaccacaggtcaatgtaaagccgtttctgagttagccagcaatcgccaaatagcgagcagttcggagagtaagccgaagtgcggtgggttttggggtaattttttaagagcgtttaaggtccttccgttggcgttgttgcttgcgggatttttctctaattttgcttatgctgctaatgtttggttagaaaataaaaaagacttatcacaaaatggacagttaaatgaggggactggtgtttggtttgacggttcaaatatggaaaacccgagcaaaactgagtcaaccatcttatcgagtggagaaaattcaacaggagaatttgctcaaaaagctggttttaaaaataaaagttttaataggacagtcgtaataggctcacgtgccgttggaggcggagatgctactacggtaataggttatagagcaattgcaggagcaaatttatctgaaagacataaattatcttcgcaaggtacatcgataggttacagaacatttgctagaggggaaggggctactgcaatgggaaatgattccactgcatggggagataacgctattgccattggttctgataatgcgaaagcaacaagcacttcacaaatagacagcagagcagaacgtcctttaagtagagatgtttggaatcttgtacacagcaaaagaagtgattttctttatacagatgaatacgcaacaacatatcaaaagttggatacttatgacaagtatttaggagtaaaagatgattctgaagcatataagctaaaaagatcccacacatgggcaaggggacataactctatcgccattggggcaagaagtatagcctacggcgataacagtacggctatggggacgttagcgacagccatcggtaactactcgacctcgttgggggcattttctatggcgtttggagatcgttcgattgccatagggaatgaaagctatgtgtatgccggcggaagtgtcggggttggtaatgaggtgcaggcaatcagtgatggtgcgatggtttatggcttggaatcttatgcgggcggtgatggttccattgccatagggaaacgtgctttagcaaacgtagaaatgggggatatgtttaagaatgctgttgaaaatggcaagaatttatacgaagcagagagtactttttcaaagttaggcgaattagataatagcgttcaagattactttaaaccaagcactgagtatcagcagggttccggggaacacaaagccaaacgaaataaaaactcaggcaagcaagatgctacaggcggtttagccattggttactatgtatccgcactaggggaaaattcattggcgttaggtcgtcaagcctatgcgaaaggcgatcgctccatggctatcggtccttatgcstatggtgctraggaaaaaacwgcygcactrggttatrgatccaaggctataggaraacaatcaatggcgttaggatcgctrtctcgtgcagaggggmaaaacagtatcgctattggggtcaatagtgcggtraaaaatgaawctarywstamwaaaagaaacggtswaaacacgatagccatcggtaaygaaaccgaagcgacsatggataactcmgttgcsttgggytataaatccacsacraaatatttttataataagagtgataacagtaccgccacgttaaacggagatgaagccattagtttgccatcctatgcaccggaagggacaagctataagttacaaaccgataatgcggcgggtatcgtgtccgtcggttggaaaaaaagcgatagtgaacttggtctaagaagaattgtcggggtcgccgcaggagcattggactccgacgtcgcaaccgtgggtcagttaaaagccttgtattacgtcaaaaaagaaggggtagtcacttactataccaaagaacctgacgggaaaatcaccaaactcaccaaagacggcagtaagttttatagagtcaacaccaaagacggcacgccttataaagagttgcaggaagttgatgcaaaagatgttttcgtcggtccaaaaggggcgaatgaagaaacaagagaagaaatgaaagacggcaaaaaatattcccttggtaatatgggtaatctaattaaatttgccaatattttagatggagagatttctgcgacttccgatcaggcggtaacgggtggtcagcttaacgatcttaacggcaaattaggattgacactaaatagcaaaaaaacaggctttgagaaagtccaatttgatgcagtagaagtagctgatgaaaacgttaaaaaaggaaaaatagaaaatttcaaagaagccttgactgactctatcgctgcaattaatagaggttataaatttattgatgacaactctcaaaattcagacaaagatacacctttctatctcggatcaacaataaaaattgtggcaggaaatatttctgcacaaccgaatagcaaacctcaagaaacatatttaggtaaaaacctcaaaacaaaatttgaaaaagagccaagcaacaattcaatcgctaaatttacgattggcttaaaagacgatccgacatttacaaaggtatccttagaggcagaacaaacatataattctgacccatcaaaaaatacagtcaaagatacaaaagaacttatcactaaaggytayttrgacggtgcattarmaaaygtygcctcaagtttcacggttaagggagatgatamaagtaaatcattkarcattgataaaartmatacgactttaactattaaaggcggaaacaatattaccacagcrgttgatactamccaaaaagccttaaccatatcrytkaawgagrstttaacagryattacctcrattascggtaaaaatggtagcggaagtaacrgaagtgcggtarcaaaaattgartttratagcactgcaagcggtagcaacgcttcaaccccgaaygtcaaaatcaccrcwggyggtrgcacatttayctttagtgaaaacggcttaaatttgggtagcaaaaaaatcactggtttagcagagggttcagacgacaccgatgccgttacctttaaacaactaaaagattcaaaattgcactttttatcggttaaagccccgacaagcccagagtcaaaaagcaattacaataatgacggtgcaaaagctgaaggggcgattgcgattggtgtggatgcgaaaactgataaagcaaatgcaattgttatagggaatagtgttactgttgatcaagaaaaatcaatagcgttagggaatgatattaatattaaacaaagtaaagcaggatattcaactgttgcaataggtaacaaaataacaatgaatgaatctggtggttctattgttttatctgctatgaatcaatggaatggtcctgatgatggtataacactaaacaatgttggttggggtgttatattaggaaataaaaccaaaatagagggcggaaacgatattgttgctttaggtaacaatatgaatgtgactaggagtaatggaagcaaacacgatctaaatagcaatttgatcatcttaggtaatggtgcaaaagcccatgatgcaaaagaaagtgtggtgattggtaatgtcgcagacgtgaaagcccaaagtgcggtagcgattggtaaaggagcgactattgaagccaatgccacaggtgcggtagcgattggggaaagtgcgactgtatccactaacgctggtgattccattgcgttggggaaaaattctaaggcggaaatgaaaaaggccgcaccgactggatttacggttaatgcaggggcaaatgacctaaaaattacttggtccagtgcaggggctggtggaagcaaatctgtggtgagtgtcggcgataaaggtagtgaacgcataatcaccaacgttgctgcaggtaaagtcgatacagattcaaccgaagcggtgaatggcggacaattaaaaagcgttatcgatgtctttgctaatttgggggtaactgtactcggggcggagaaaaacgatactggcgatggctttaagaaatccaagtttgatgyggtgaagactgscracacagtaaattctcaarctcaagyaaaatctgagaaaycctttaaaacagccattgaagataatattacagccatcaacaaaggcttgaaatttgctggcgataacggcggcgaagcgaagcaactctatctcggttcaaccttaacgattaagggagcgacaggtcctgcttcaaaaccaacaacaagtgcggggcaaaacggtgcaggtactcatcaaaatatctttaccacagcgaaaaatacaggcattttggaaattgctttgaatgaagagttgaaaggtattaaatccgttgctaatggagacgatgtaaaaattgaattaaaaactactggaactggtggaaatggaactacaaaatctatcgttttcacagctggcgatacaaacaataaagtaacgctaactggcaataaattcagtggcgtgtctgaaattagcagtaaagacagtaaatctaaattaacacttggtgctgataacgcaactgtagaattagaacatggcaaatcaaaacttgaactaaaagatactgaagcaacaatcacagcaggaactgatgctggaagtattaaaattaacaataacggtgatacgaaaattgagttaagtcctgaaagtggctctacagttaccttggcaaaagacagcacgaatggcgtaaaagccacaggtttatctacagttgggttagatggtgataatactttagtgtttaaaaatggtacaaatagcactaacacggcggagttaaaagtcggtggtgcagctttaacattcacctctactggaaatggaactggcggaamtgctcaaaccgtgaaaatctcwaatgtggcagmtggaaaaattgatactarttcaacygaagccattacrggtaaacaacttgcygatttagctactcatttaggggttartgttgatartggaaaaactgggtttacagcaccatcatttgaagttatcaaaggcggtactaaagacgcaacgagcggtaagaatggtcctacaacctttaaaggagcgattgaccagttaatcaccgcagttaatggtggwttgacattcaaggggaatgataacagttcgactaaattacaattgggcggtactttaaccattgatagctcaacggttggtagtggtagtgaaaaagacattacagcaaaactggaaccgtctaatggtaatgattctaaagatgcagggaaattaacattaacgttaaataaagctacttctgtagataaaaatgacgaaaaagtcattacctcaaaagccgtagcaacggagttggaaaaatatacgaaaactgctgatttaggtaatgcgtatttgaaaatagatggatcgaatattggcgatgcttccaataaaaaaacattcggtggtcatgtcggtattgctgaaatcaagttagatggtgaaaaaagcagcactgaattagtacaggcggatgcggttattaagtacctaaaaggtacaggaccagattctgtaaaaatatcagactcaacaaagacaatggctaaaggaaattactcaataagtataggacatgaagccgtatcagaaaatgcagaatcaatagcgataggatatatgactcatgcacaaaataaaaaatcgatagcattaggtaatgaaagtgaggtattgggcgagaaatctattgcaataggtacagagaataaaatagatggtgagggtaaatactcaaccgtattaggcgtagagaataaggtatcaagtaaatttacttatttaataggatacaataatgatatcaaaggagataatacctttgtattaggatctaatatattaacagacaattctattaaaaatgcagtaatacttggagatagatcaaaaggagaagcaaatgcggtatcagtaggtggtgctggcgatggtgaacaacgaagaattgtttatgttgctacaccaacggataaatacgatgcggtgaataaacaatatgttgatggacttggattaaaattcaaaggtaatgataatmaagagatacataaaaaattatcagacacattagaaatagttggtaagggtttaaataaagctcaaactactaaatttaatggmacaaatggaaatattgctgtaaaagaaaataaagggaaattggaaatatcattaaatagagatttaaaaggaattaaatctattagtgatagmaagaataaaaatatagctactgaaataagattcaatagcaaaaatagcacaagcagtattcctaacagtttgacaaataacctaactatttcttcaaatggaggcacatttgaatttaatagaacaggtttgcatattaacaataaacaaattacagggttaagaagtggactattagaaaaacataatggacaagatagagaaagaaaagatttaaactatttaataggagatgaatttaaaaattcctctattcaaactcatgcagtcaatgttggagatttagcgaaaatttctaaggaaatagttgaaaaaggatataagtataaagctgatattccgtcaaataatagcaatgataccagcataaaactaggctcaaccatatctattgttaaatggacagacacaccggcgactggacaaccagcagtaactgttggcacaggaacaacttctcaaacatcagctgttaagtacacaggagataatttaacaactcgatatacctatgacagtagcaatggcaacgctaaaatcgaaatcgggtttaaagacgcaccgacatttagcaaagttaccttatctcaagctcaaacatatggtaagggtagcagtgttggaaataacgacttgattagcaaatcctaccttgacgctgcattaaaagactttaagtttaatgtggaatatggtggtaagcaagtccaaatcggtcgtggcgatacgttgaagtttgcagacgggctgaatattaaactggagttaaaagaagtcgaaaaaccggcaaatgaggcaacgtctaccattaattcaaatatggaaacttctaccccagcaccaacaacagtaagtaccccatcagatggtgcaaatgatgcagacgtggctacaacaacggcagaggtaaccattgacacgactgaggaattgaaaaacatcacttcgatttcctctaaaggaagtgcgggcggaaatgatgctgactcaactgtagaagtcaccaaacttaccttagaagctgataaaggggcgactttccgagtgggcaacacgggtgctaaagtgaatgtcaatagcgatggtatttccctcacaccgaaaggggcaagtggtacgagtccatctgacgatgtagcatctatcactattaaagcaggctcaaaaccagtggattcaaacagtatagatttacttgatccagctaacggaccttcaatagcgtttgcagccaaaggcggtagtaatggctcaaaagagggaacyggtacaattaaatacctyaaagacagaactgttagcaaaaacaatggcaacggcgataaatacggtgagggcgataacaaaggcaacgcwgcyacagaaggggcggtgaaagagctttatgamtccggyttgaaattcgccggcaatgaaggtgagcctgttcacaaaaaactgggtgaaaccttgtctattaaaggcgaaggtgcggttggtgaaacggcgacggataacattgtggtaagagccaaagagggtgaactgcaaatcggtctgaccaaaaatattagaaatattgacaccatttctatcgctggcacaggggacaatagcggtaaagatgtctttatagatgctgagggtatgaccactactgctcaacttgaagatggcacggtgttggtgaataaccaaacggctgaaggtgtcagtacaatagctaaaaaagaggatggtagcattttggtgaataatcaaacagcagaagcgaatattttaagcaatggcaagcacacgacagaggtgaaagccggtgaggtcgctattaaagacaagagcggtcaagaaatcgtgagcttgaaagtggctgagggtgaaaacggtcaagatggcaagggagcgacgcttgcgtttgccaaagatggcgaaaacggtacaggcgtaatcatgggcttgaaagacctagatgccactgctgacggttcaagtgcagcgaataaaaactatgtggatgaaaaaatgtccgatttggacagcaaccgtccgtttaacttctatatccaagagggcaaagagtataccaaagtcgtcaaaggacgtgatggtaagttttatgatcctgagcttttacaaggggcaaagtatgatgtggacagcaagaaatacattgctcaagatggacaagaagttacaccggaatcggataaagtcattattcgtgctgaaccgactaccgcacctatcgggattaataatgtggcaagcgggttgggtattttggctatagaagaaagcgagaaacaacaacttacgcaagctgttgaagataagaaaaacaaggtaagcgaaagtgaaaaggctcttgctcaaactactgctgatgttaaaagtaaacaacaagcacttactgaaaaaacaaatgagctttcacaagttgccagcgaacgtcccgtattgttgatgcaaaaagctgaccttgagcagaaacttaaaggattgggtgcgagcgatccacgaagagcaaccgcacaggaagctcttagcaaagtggaagagatactcaaacaaaatgatcaaaaatccattgaaatagcaaaagaggttaaaacggcttccgaaaatcttgataaagcgaaagtcgctttggcagacaacgtgttaaaagcctatgcagcacaacaagcattagctactgccgaggaaaccttgcgaaataaagaatttggcgtggataaggtgaaagacttactgtcaggcaattcaaatattgctgaggataatgtggctactattaaagatgtgaaagcacttgctaaagcaggattaagttttgagggcaatgatggtaaacgcttgcataaagatctatcagaaactttagcaatcaaaggtgaagaaaatgcaagtggtgataaatttaatagcgaccacaccgccgccggcaatatcaaagtggaaatggcacaagacggtaaaggcttagaagtcaaattgtctgaccagttgaagaacctcacatcggttgaaactaaaaaagacgaccaaggcagatcaacaacattgctgtcccgtggagtgatggttcaaaatgacaccacaaaagaacaagccctgttcagcgaaaaccgtttagcgttctttaaagatggagcgttaggattgaatttagacggtaagtctcgtgcattgaaagtcggtgaaaaagcgatcatcagtataaacgacaaaggtgaagcattggtttccgatctgaatgaatttagttcaggtatgacaattaccaataaaaactatgtggataccaaaaacaatgagttgcgtacgcaattgaataatactgaccgcactttacgagcaggtattgctggttcgaatgcggcggcagggttggcatcggtctctatgccgggtaaatctatgttagccatttctgcagcaggttatggcggggaaaacgcagtggcaattggctattctcgcatgagtgataatggtaagattatgctacaactgcaaggaaatcggaattctagaggcaaagcggcgggttctgtttctatagggtatcaatggtaaattgattcgattgtgccttatgtccacattttgttattgaggatataaggcataaaaggcgtgctctgttttaaaatcaacttggtagttgttgttcgatttattgacgagttattaagtttggtttctttttacatagacaaggtttaaaatggattagattctgttttaaaccttttttacaactggacaaatcttttaatatcaagaataactgtctgtatctatttcaaatagctatattgctatctatgatgatggaatgttgatcttgatgtttgtagcaaaaaattacatagactttaaacgaggataagaaatatggaaaaattcgatgttgtgattattggtgcaggaccttctggttctgtttctgcatcattattgcataaacaaggcttaaaggtgtgtgtattggaaaaacagcactttcctcgttttgtcattggtgaaagtttgttaccttattgtatggatattttgcaagaggcggacttggttgatgcggtacatgctgagaaaagttttcaatttaaaaatggtgcggcatttacttggggaaaccgttacacctattttgattttacggataaatttactgccggaccgggaacaacttaccaagttcgtcggggcatttttgatcaaattttgattgatgaaacggcaaaaaaaggtgtggatgttcgttttggtcatgaagtattggcgtttgatcatcagggcgatcgggcggagctgacggtaaaaacggagcaaggggaagaatatcgactgagtgcaggttttgtgttggatgccagcggttacggacgtgttttgccacgcttattagatttagaaacaccatcgcacttgccaatacgtattgcacattttacccatattgatgacaacattgatgatccgatctttgatcgtaataaaattctcattaccacacatcctgaacatcgtgatgtttggctttggttaattccctttgcggataaccgttgttcaatcggtgtagttgggttaccggaaatattggcgggtgagagcgaaactgtgttgaaaaaatttgctcttgaatgtccaatgctgagtaaaattcttgctaaggcaaattgggaaaatgaatttccgtatcgccatattcaaggttattccgctaatgtgaaaacgttgcatggcaaacattttgctttattgggtaatgcagcggaatttcttgatccggttttttcatctggcgtgactattgcgttacattccgctcgactggcaagtcgtcttattgctcgtgggcttcaaggacaagctgtggattggcaacaagaatttgcagatccgttaatggttggcgtgaatgcgttccgcacttatgtgaacggttggtatgattatagtttccaagatgtcatttatgcccgtaatccacaacctgaaattcgccaaatgctttcgtctattcttgccggttatgcgtgggatgagaaaaatccgtttgtggcgaaatcctcccctcgcttgaaagcacttgcggaattatgcggcgaggcaacacaagattaagataacaatatataagcattcaaaaattgctatttgcaaacgttgagtgcttttattttttcataaggaaacaccatgccatcgtttgaaaatctttcttttattaccgcacttttatttttttgtatttgtctcattttattttttatttttgtacgtaagcaaagagaggtggaggcattacaacaagagttagataaaaatattaatatttttaatcaattgctgaataaatatgaacgtataaaagacgaaaaaactcagcttgggcaacaagttgtaaaggcacagacacttgtcgaaagcggtcaaattcgtttgtcggaacgtgatgaaaaaatcctttatttgcaaaaagaattagataaagaacaattacggtgtgagcaagtttctcagctggtaacaggattgaaagagcgtttgggggtagtaagtacacaggcggaaagttttcaacagcagttaaatcaaagtcgtgcagaaaaagaaaagagagattgtgcttgggctgatttaaatcagaaacataccgcacttcaacaagaactgacagaattaaaagtcacgttaagtgaaaaagaaaaaaattttgtcgagcaacaacaaaatttttctcaggctaaacaactgttaagtgttgaatttcaaaatcttgccaatcggatcttggaagaaaaaagtcaacgatttaatcaaactaaccaacaaactttagacagtttattgaaaccttttcgtgaacaaattgatggttttcaaaagcgggtgaacgaaattcattccgagtccttgaaaggcaatgccagccttgaaagtgaaattaaaaaggtgttggatattgggttagctatgtctaaagaggcgaataacttaacttctgctttgaaaggcgaaaagaaaacgttggggaattggggagaggttcagttagagcgtacattgcaattagccggattgattgaaaatgagcattacagcagtcaagtacattttaaaaatgagcagggcaaacataattatcctgattttattttgcatttacccgataataagcagttgattattgacagtaaaatatctttggtagcttatgaaagtgcggttaattctgacgatgaaaatcaacgcaaacttggtttacaggaacatgttaaagccttaaaaaatcatattgatgctttgtctggcaaggattacagcaatttgatcggtatgcgtagtccaaattttgtattgatgtttgttgctgttgaagcagcttatattgaagcgatgaaacatgacagtaacttatttaattacggatatgaaaaaaatgtcattttagtttctcacacgacattaatgcctattttgcggacagtagcgaatttatggcgaattgagcgtggtaatcttgaggcaaaagaaattagtgcaaaagcaggtgaaatttataatcaaatttgcgtagtggcagagcgtttaaataaattaggtaacagtttatccggtgtaagtaatcattataataataccgttaccgcacttgtaggacagcaaggtttggtggggaaagttgagcggttcaaggatttatccgctaaggcgaacaagataatgccggagattgaattgttgcataatgatataaacgttgagaaattaattgccgttcaagctgaagtcgaagagaaataggatttttaggtaaaaatcttttaaaataatgacagttttgacataagagggaatacattatgattattgttacaggtggagccggattaattggaagtaatatcattgcggcattaaacgatatgggacgtcgagatattttggtagtggacaacctgactgatgggacaaaatttgtcaatttggtcgatttggatattgcggattattgtgataaagaagattttattgcctctatcattgctggtgatgattttggagatattgatgcaattttccatcaaggcgcttgttctgctacaacagaatggaacggtaaatatttaatgcaaaataattatgaatattcaaaagaactattgcattattgtctattgcgtgaaattcctttcttttatgcctcaagtgcggcgacttatggcgataaaacagactttattgaagaacgccaatttgaaggtccattaaatgtttatggctattcaaaattcctatttgatgaatacgtgcgtcaaattctgccgcaggctaagtcgcctgtttgtgggttcaaatatttcaatgtatatggtcctcgtgaacaacataagggttcgatggcaagtgttgcattccatttaaataatcagatgttgaaaggagaaaatccaaaattatttgcaggatcagagcattttttgcgtgattttgtttatgtgggcgatgtggcaaaagtgaatttgtgggcatggcaacatggtatttcaggcatttataattgtggaacaggtagagcggaaagttttgaacaagtagcaagagcggtgttgaattatcatggcaaaggtgaaattgaaactattccgttccctgagcatttaaaatcacgttatcaagaatatacacaagctaatttaacaaaattacgtgccgctggttatcaggaagaatttaagtcggttgctgagggagtagcggaatatatgaaatggttaaatcgcaagtcttgatttagcgaggaaaatagcgttaaaagtacggtttaattgggtgttcatttattcggtattccttttaaatctgcaactaaaaaggctattttgctttataatatcggcaatcttcactgttattggtcaaaacctatgaaaattctcgtgattggaccttcttgggtgggtgatatgattatgtcacatagcctatatcaaaccttaaaacaacaatatcctgattgtctgattgatgtattggcaccgaattggtgtaagcctttacttgcacgtatgccggaggttcgcaatgcgattactatgcccattgggcatggttcctttgacttaaaagggcggtatcgaattggtaaatctttgcgtaatcaatatgatatggcgattgttttgccaaactctttaaaatcggcttttattcctgcttttgcaaaaattccgttacgccgtggttggataggcgaaagtcgttattttttgttaaatgattggcgtagtaataaaaatgactatccaatgatggtgcaacgttatgtggcattaggttatgacaaaactgtcttaccgacagcaaaacatttagccattcctaagccttatttgcaagttgatgctcaagagttggaacaaactttagaaacttttgcaaaacaaaccgcactttgtacaaatcgtccggtaattgggttttgtcctggtgcagaatttggtcctgcaaaacgttggccacattaccattatgccgatttagcccgacagttaattgaacagggctatgccgttcgtttattcggttcggtgaaagataaagaggtaggtgagcaaattagtcaagcgttgcctcaaaaattacaacattattgtgtaaatcttgctggtgaaacagacttaaatcaagctgttgatttgatttcagattgtgtggcagtagtgagtaatgatagcggtttaatgcatattgccgcagcacttaacaaacctttggttgctgtttatgggccaacaagtccggaatacacgccgccactttccgacaatgctgtgattattcgtctaattgagggaggcttgattaaagtgcgtaaaagtcaagatagctcggaaggttatcaccaaagtttaatcgacattacaccgcaaatggtcatcgaaaaattacaggattttttaaattaatatgaaagtttgtttgattaaaaccagctcaatgggcgatgtaattcatactttgccagccttgactgatgctcaaaatgctattgctgatctgcaagtagattgggtggtggaagaaaattttgcggaaattccccgttggcattcagccgttaatcatgttattcctctagcaatacgacgttggcgtaaacagatttttgccgctcaaacaagaaacgaatggaaaaattaccgcactttgttacaacaaaatcaatatgatgcggtaattgatgctcaagggttagtgaaaagtgcgttgtttggagcgagtttagcgaaaggggtaaaacatggttatgatcgtcattctattcgtgagcctttcgcctcatttttctatgacaaaaaatatactatttcttatcaacagcatgctgttgaacgtattcgtcaattatttgcccaaagtttaggttatgaattgcctcacgaaaaaggtgattatggtattgcgaagcattttgtgcattcgactgaaaatgcacaacattatgtcgtttttgtccatagcactacaagagcggataagcattggattaatgctgaatggaaaaaattagcccaaaaattgaccgcactaggtttgcaaattcgcttaccttggggtaatgaaaaggaaaaagcacgtgccgattggattgcacaagatattcaaagtgcggtagttttaccaaaactttcattgaccgagttggcacaacagattacctatgcaaaagcggtagtttctgtggatactggattagcacacttgaccgccgctttagatgttccgaatattactttatatggagcaacagatccgaagttgatcgggacgtatggtaaacatcaacattatattcagaaacagggtatggcgttgattagtgcggaagatgtgttgagtgaattacagtcaaaagaaatattgaaattttaaccatagaacatctgcactttgcatttacactaagtgcagatgaatttgattataaacggataacgccgtcataaatatgtgttgcctcgccggtcatataaagtgggtgtccttttccttgccattcaatcattaaccttcctcccggcaaatcgacttgtacgcaactacctaaaacgccctgcataatgccaacggcaactgctgcacacgcaccgctgccacaggcttgtgtttctcctgctcctctttcatacacacgcagtttaatatgactgcggttgataatttgcataaaaccggcatttacacgttcaggaaagcgttcatggctttctaagagcggtcctaatatttcgatgtttgcgtgttgaatatcttccacttgtgttacacaatgtggattgcccatagataccacaccacatagcaaggtttgtatgtctgtgcgaataatataatttttttcaaatttattggcgttaaaagggattttattcggttcccaaatcggttcacccatattgacacataccatgtcatcgtctttaacgcataacatcattttgccttttgcagtactcacggcaatttcttttttattggttaaacctttaagcacgacaaaacgagcaaagcatcttgcaccattgccacattgcgaaacttcactaccgtccgcattgaaaatacgatagtgaaaatccaaatccggatcataaggcggttcaacgactagcaattgatcaaaaccaataccacgattgcgatctgccaatctttttatgacttcagtgggaaaataaacgttttgagtgacagcatctaccacaacaaaatcattccccagtccgtgcattttggaaaattgcatttcctcttccttaagcaaattaaaattggagctattataatcagctgcttaaattgagtaaatgagagaaatcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggagttaaattctaaaagcaatattctctccgcactttgaggcggggagaatgttaggttgttgttttgtaccattccaaaataaatgcggcaatttgcgtcgggttgttaatatccagtaaaggaacggaagtctgtacaggataatctgtcgctaacgctattacatattcatcacaaggcggacaaggttttgtcatattttgacgatgtaataaaattttggcgatggggtcttgtttaaacccttctactaaaattaaatctgtcaattggggtgaaaattgttgagcaagataatctaaagtgacaggttttggcgtttcggtcattaatgcccaacggttatcacatgccaacataacttgtgtcgcaccagcctctttcatacgccagctgtcctttccctctttgtcgatttgtgcgttatgatggctatgtttgattactgaaacccgcaaacctaaacggagcaattcaggcagtaatttttccaataatgtggtttttccgctaccgctataacctgtgatacctagcatgggttgcatataaattcctcttttattgaataatgcgtaacagaatgggttgaaaggcctttttatgttgccattttttactgtatgaatggataagcacaaaagaaagtgcggtacaaaaaaggataaaaattgcaccccacaattcttggctaaaaatttggtttgcaatgagtgttgcactgagcaaggtcattaaaggaataatatacaataaaagtgcggtagaaatcagagaactttcttgtaaaccaagctcaacaatttgacctatttttaagggtatcaggctattaacgataaagatatgctccggacttttgccggttaattcagaaagtgcggaagttccacaagtattttttgctgtacattggctacaagcatttttgctttgacatttcactgttgcttttccttgatgataggcaatgactatcgctctttctgttagcataaaaaacctatttaattcgaatatcttgaataatacgtttagcggaaaagagaggaagttgaccgacaaaggttaattctttgttacctagagtgttgctgtaaaaagtggtggagccttgcttccaaaatctttctccgtcattatcaacaatgctgttagacaaatagagtgcaaaagaaaatagtccgtcactataaaattggctctcaatagggtgtttattgtctttttctattgttatggattgactaattaacttaaacccttttgggagccactccggtttccaattttgttgttgagttttcggttcacttaataacggaggaaaaatgacattatctatatagctacctaattcgatcagttcatcaccaagatataaattaactactcggaactgctctaataaattgccttcacgatccaacatatcactgcgtagcaacaaatgattttgttcatcgataaagactaaatattgatagcgaaaatcgtctttaggcaaaatacgtaaagtttgtacaatgcgatccgccacacgattacgcccaatggttacgatatcgtaataatctgataattgcttaacatcactccacattacaacaggtaagttatccataatatgaccgctctttaaagagaatgcttggaaattaggtggaaaataactcactaaattttcatgttggataatttcttgttgaacaccatctaaggtaataagttgggcgtaacttttgccatcctgattaatatgacgataacgaagtgaatctatattggttggtgtggcttgtacaaaataaatttcataatttaatgtattttgtgctgcaatcattttttccaataattgctcaggttctatattttcttgagcgaaagttgaaactgaaaaagtaagaagtgcggtcaaaaaagagaaaatttttaacatagtattcttcctaagaaaaaaattcaccaccaaacggtggcgaatatcttaacatgaattgagctaatgttcattatttggcaatccgaaactgtcagtatgcagacgtcgctgtaattcatagttttgtaacattatgccaatacgtttgttccgttgttctacttgctcttgcgtaattatttcttttctcggaacattatagctgatttcttgtaccgaattattaaatggaagcgtttgtagagttggggtatccagtgtatttttgcccgctctttcatgattaaaagattgaacgccaagtacggcaacgaaacaaaccgttgcagcaactgccatttgtaacattggggaaaagaatgagcgtattttttgtataaacggaagtttttccacttctgcgagtgtcggttgagactcgagagaatgttcgatttgtattttttcttcctgttcaatgagcgttcccattcttgctgtgaaatcagaacctaacagcactttactttctttgcgtataatggaacgaattaaatgataatttgaccaactattttgtaaatctttgttttgacaaagggtgtcagtaaatttgttaccacaatgctcaccatcgatataagctgaaagtaactctttttgcatctttaactccaagtctttgcttattaaactatttaacgttgtatcaaaggttgaattttgctttcgattatttctcttgcacggaaaatacgagaacgtacggttcccaccggacaatccataatttctgcaatttcttcgtaactcaatccttccatttcacgtagtgtaatagctgtttttaaatcttcttgcaggttactgatagtatcaaaaacaacttttttcaattcactggataatatttcattttcgggagtattcacgtcccttaaatttgtaccaacattataactttcagcgtcttccgctaatatatcctctgttggcggacgccgtccttgtgccgttaagtaattctttgccgtattaaccgctattcgatatagccaagtataaaaagcactttcgccacgaaatgattcaattgagcggtaggcttttataaaggattcttgtacaacatcgggaatatcgttttgtgaaatataacgagtaagtaatccggcaactttattttgataacgagcaaccaataagttaaaggcctttttatctccctgctgtactttttctaccaaagcctgatccgttagttgttcagccatataacctcttgtatcacatctaacaagccttaatattaaagccagccaacccttgtgcttgttagacgtaatggaataaaaaaagttcaatctttttaggaaagattattgatataaatttaaattttcttgaatatgatctaccatctcttgtaattcaagatcagcagccggagttttgttaaaaaaccaagaaaaaagttgtaaatccgagcaagctaataaacgcaaaaatatatcttttttagcatcaggtagttcatcaaaatattgttgaaaaaaaggcataataactttatctaattccaacatgcctcggcggcaatcccattcaatgcggaatttgttgtatttttccatgcttaatttccttttatctaattttcttgttaatagtaacaatcggaagaaacgctgtaaataaaagagaagaataaactcggttcggatagattttaggtgtgcaatataaatggcatacaaataaggcgtattatatatcaatacgcctttgctcttaggtgtaaatccctttaacttttaaccagctctactacttcacgggttaatcgtccaatttcttcccattgttgggacttaatcaaagatttctctacaaaccaagagccaccgcaagcaactacgtttggaatagcgagatagtctttgatattttgtggcgaaatgccaccggtcggcataatttgtaagttaccgtaagggccaagtaaggcttttatcattttaacaccgccacttgcctcagcagggaaaaacttgacagcttgtatgccgagttcaagagcggattcgattgccattggattatttaccccaggcgttacaggtatatttaactcttgacaatacttcacaatatttggattaaagcctggagtaacaatacaatctgctccggcatttttggcagccaatacctgttctttggttagcaccgtgcctgcagctatgagtacttcaggatattgttggtgaaccaatttaatggcctcttcggcagcttcggagcggaaagtaatttccactacaggcaagccgttttcagacaatgtttttgctaagggtaaaatatcctctgctttatctaaagcaataaccggaacaactttaagctgtttcaacttgtcaataatttgttcagtggtataacgcatttttaacctcttttttaatgtgaaaaaatttctttaaaatggttattttatttgaaataacgttttgcattgtcatagcaaatgtctttcaccatctttcctagtaggttgagatcatttggtgcttcgcctcgttcaacccagccaccaatcatttcacataaaatacggcggaaatactcgtggcgagtgtaggataagaaactgcgggaatcagtcagcataccgacaaattggcttaatagtcccaattgtgagagttgctgtagttggcgttccataccatctttttgatcgttgaaccaccagcctgaaccgaattgaattttgcctgcaatgccaccggtttgaaaattgccgatcatggtaccgagcatttcgttatcacgaggatttaagcaatataaaatagttttcggaagttgatctgtttgatccatactgtctaataagcgagacagcggttcggcaaacaggcgatcgccgatcgaatcaaatccggcatccgcacccagtaatttaaacattctcgtattgttgttacgaattgctccaatatgcaactgcattacccaatggtgtttgtggtactctgtacctagccaaactaacagtgcggtactgaattgtgcgatttcttcttctttraktgattgattttttaatcttttttgcagaatgccgtcaagtgttttctcatcaggaattggtgagaaacggacaatttcaataccgtgatcggcagatttacagccacattgatcgaaatgttcaatacgtttcgataaagcttgttttaatttgtcgaacgtgttgatttcaatatctgcgacttttcctaattgttcaatataatcattgaacagcgggagttcaattttaaacgcacgatcaggtcggaaacttggtacaacttcaatatcaaaggtattatcttctgcaatggctttatggtattccaatgaatcaataggatcatcggttgttcccactaaacttacattcatttttttcataataccacgtgctgaaaattcaggctgttgcagtaactctttccctttatgccaaattttctccgcagtttcgggtgaaaaaatcgtattggtaataccgaacggacgacgtaattctaagtgggtccagtggtaaatcgggttaccgatacattttggcacagtgttggcaaaagcgagatatttgctgtatttatccgcacttcccgtaattaaatgctcttctacaccggctgaacgcattgcacgccatttatagtgatcaccctctaaccagatttcagccaaatcattaaattggcgattttctgcaatctcttttgggtttaaatgacagtgatagtcaaaaatcggctgttccttggcgtagtcatggtaaagcttttgagccgttgaagttgatagtaaaaaatcttccgtcataaatttcatcattatgtcctcttattgagttattttttgttccaatacacttgcattttcatctactttttctttagaaagcggataaacgtatttcaacagtaaaaaaatcaagaggcaagccaatgcaggtactcccgttgcaaagttatagattgactctaacacttcttgtggttgttgtgggatttttgcagaatagccaatgtaacttagtgcaaagccacctaaaccaccagctaaagcttgaccgattttgcgagcaaatgaataaactgcataaattgtgccatcttcacggcgtccagttttgataaattggttatcaataatatctgtaataaatgcccatataataatttggaaataacttagacctagtgttgcaatgagtgcgacaatgataaataaccaaacatttgtgattttaacgaagaatagcacactgtatatgacagcagttatcaataaacctacagaagctgattcttttttaccgtactttttcacaatattttgggcaaacggagcaactataaatgttgtcacggcacctaaaataccaccaaatgacaatgctaatttactattaaagtaatcaacatacaaatatgggttcattgtaccgatgattaaggttgctagcagtaaaatgatagcgattaaaataaagataagtaacgcactgtttgagaatagactgctaaagattgcttttacgtcatctaaacagtctgatttattgtgtgatttgttgtggcgacgaccttctttttcaggcaattgaactcgctcaaccgaaaatctccaacagatttggtacaaaataaacgcacagatcataaatgctcccataatgtatgtgaacatttctgggataattacttgtttaccctcaacttctttgtaaataatgagtggaattacaaatgagataaaaagtaccgcaatatttgcacccactgtacggaagatagataatccggcacgctcatcagcttttgtagtaatcacggaagccattgaaccataaggaatattgaccgctgtataggctaaactaccccaaactatgtaggtaacagtgatgtagaccaattttgcggtataagaccaatctttcacaatgtgtaagaaaagcagaaatcccgaaatacagataaagggagttgcccggcgaataagacctctgaaacgcccctctttaaaaggctttatagtatctactaaacgtcccataccaatatcagtaaaagcgtcaataaatctagaaactagaaatagaagaccgacaacataaccttcaatttgtagcacattagtataaaatagcattaaaaagaaggcggacatcataaaactaagatcattagcaatatcgccagccatataggcaagtttgtcttttaaaccaaaaggtctttgtgttgaactcataaaaactccttgtgaggaatatagattaaatatgggtatctttataaccgcagaacgcatcaactgggctaatacctttaaactcggaattacccattaatttttctaccagcaattctatggttggctctttgccgtcataagcattgatgtaagtttttacttgaggaacatcaactaaatggaacgggcattgaacggaaacgaaaattgttggtacttcatgtacatagaatggaatatcaggcgttcctttggtcgcttgccatacgatacgttgaactgtactcatttgcacattcgcaacattgataatcagatcataatgatcggttaatgtcgtaattgggcgtttttgggagtattcattacgaatagttttgacctgttcttcgtccgacatcttgagaatattatccatcggtgatgtataaatagaaactgtaaatcctttttcttccagtttttcttttaagatttctgttgcactgcgttgactacctgcaaccattttaccgaagccaccatctgtacctttaacatttacaagtaagattctagggaaacgttcaacattaattgggaaaatatcttgtttatgtttaactaaggtaattgctttatctgcaacatcacggaaaattgctttatgttctggaagtcctatttttgctaatgcttgttcttttggttcaagcaatgtttctcttgggcgattgtgtaagcctaattttgcttttaaccctagaatacgagtaagggcatcatgaaggcgttcttcggtaataatgccgtttttataaccttccatcatataaccgaaatcttcatcaggatcgttaaagaaaaggaataaatcacaacctgcagcgatagcagtcggtagcatttcgctacgcttcattgctgaagtcattgctaccatatggctggcatcagtaacaacaacaccgttgaaacctaatttacctcgtaataagtctgttaaaattggttttgaaagtgtcgctggtaggcagtcctcataagctaaatttggattgaaatgctgctcgtaagcaggtaagtgtatatgacctgccatcaacgatggtaaaccggcatcaattaagccttgataaactttgccgaaagttttgtcccactcttcgcaactaaaactgtttacactaaaagaaagatgctgatctctttcatccactccatcaccagggaaatgttttgcagccggggcaataccactttcttgaatacctttcatataagccaaggacatttctagtactttctctggatttgaaccaaatactcgattagaaataattgggtttcgccagttataactaatatcaacgataggagcaaaactccagttacaaccgatagctgctgcttcaataccagctacacgccccatttcataagcatatttagcatcatcggttgcaccgattttgacttgtaaaccaatttctgttccatcactgcaagcaccattaccaccagcttctgtattcgctgcaattaagagagggattttacttttagtttgtagaatatagttttggtcataaacctcctcagcaggaccgggattataacgtaccgcaccaatatggtaacggtttaaaacatcagtgagatattcctcggatctgcttgaacccatattcacaaaaagctgaccgattttttcttccaacgtcatattagctatagtgttttttacccattgaatatcttcatcttttaagtaataaggttttttcgttaaatcaacagacataatttctccttgcttatttgtcaaaatagtaataattgtgatcaagcggttaaatttgcattaaattttgcaaccaattgggcttgatattgagaatcaaatttttggtaaaccaatttccctaatgtttctaatactaactgatcccaagattcatcttcattgccacataaaatcgggaagaaatttacacttgcttcattggcactatttaaatcacccggcgaatcaccaaccattaaaatattgttcggttgatagccatattgtgctaattggtttaaacaatgagtttttgtaccctcatcttgtccataaactagatctacaaaagggagcaaaccatgtcttgtccattcatcaagaatagcttcattatttgcggaacttaccacagcgatgtctgcaaactctttaataatggcgagggaacgtttgactaaacggaacggtttatcttgagtatgtagagttttaatacccatattgactttttccgaccatgctaacgcaagttttagatcatcggtatggttgtcttgtattgcttgaataagtgaacgattggataattccgaagttgtatttacccagtgttttaattggctgaaatcctgttcataaccatactcttccaaagaaagaatcaatcctttgaatcgattgataccacgtgtttgagagtaaaggttaattctattccaaatttcaataaaacgtgcttcatctgtaagtccaaaaatttcaacagcataaggtccgaaacacttatcatgtttaatgttcattgtatccattgcacaaccgtcagaatcaatgcacacaataaatttatgttttggtataaacgttgtcattattttcccctatacaccgctgtaagcagagaaaccgccatcaatcggcaatactaccccatttatgaagctggcataattttcatccattaagaataaaattccacccatcaattcatgtgcttcaccaaaacgtcccattggagtattagttaaaattttattagctcgagctgtcggatttccttcactgtcaaaaagtaatcctctgttttggttactgactaaaaaacccggagcaatggcattacaacgaatacctactttagagaaataaacagcaagccattgggtaaagttactgatagccgcttttgctcctgaataggcaggaattttagttaacggagtataggcattcatgctagagacattaataatattagccccttttttgccgatcatatctttggcaaatacttgagtaggaagtaaagtacctaaatagttgaggttaaatacaaattcaataccatttttatctaaatcgaaaaatgattttgtactatctgctaagttaaattcatgaaattcattgtcggttgttgcttttgggctattaccaccggcaccattaatcaacacatcacaagttccaaagtctttttcgatagcatcacgagtttgttgaatactttccaaatcaagtacattggttttgtatgcttttgcaatgccaccattttgtacaatagcttgtgcatattgttctgccgattcgaggttaatatctaataaagcaacttttgcccctgtttttgctatttcttgtgcaaaaaatgcacatagcactccaccagcacctgtaataacaacgactttacctttgaaatcatgattgtttgcaatattcatatttttatctcctattaagattaattgatatgctaaatatacgtctatttttaaaactggtaaaccagttattaataaaagtgtgatttacatcacaaaatttaaacttttttggtttaccttttggttttttatgtaaaatatgcttaaattatagttgttttttggtgtgagaaatgttaatttggtgaaccaaaaaggtattttacgaacaccatcaagaagtcaaaaaagcagagagacaaaaaaatgatggcaacatcacctgaagaactacgttcttataaaaaaatagggcaagaattaaaagcggaattattgagaggaacttatggtattggggataaattaccggcagagcgtgatttatctcagtacttcaatgtcagtcgtactgttattcgtgaagcacttatcatgcttgaacttgagaatttagtcgaagtgcggaaaggatctggtgtttatgtaataaatttacctaaatcgagttcagaggaaactgaagatttgcctgatgttggaccctttgaattgctacaggcaagacaattgttagaaagtagtattgcagaatttgcagctattcaagcaactcgagctgacgttttacacttaaaagagattttagatcgtgaacgtagaactttagagtgcggtgatgatgaagattatattgcagatgaggattttcacaaagcaattgcagaaataacgcaaaatgaagtggtgatccgcatgcaaaaggatttgtgggagtaccgaattaatagtcctatgtggaaaggtctgcatgcacatatctctgatcaaagttaccgctatttatggttaaaagatcacgaaaatattattgttgcaatacagcgaaaaaatcctgtattagcacgaaaaatgatgtggcagcatttggaaaatgtaaaacagaaactgtttgaattatcggatttagatgatcctaattttgatggttatctgtttaatgttagccctttggctgctgatttttaattagatgaggaatttactatggaacaaacatggcgttggtatggaccaaatgatccggtatctttggatgatgtaagacaggctggtgcaacgggagtggtgactgcattgcatcatattcccaacgggcaagtctggtcagttgaggaaatcaataagcgtaaagcattgttggaggaaaaagggttggtttggtcagttgtggaaagtgtacctattcacgaagatatcaaaacccaaacaggtaactatcagcaatggattgataactataagcaaacattgcgtaatctagcgagttgtggcattgacatagtatgttataactttatgccggtgttagattggactcgtaccgatcttgagtatgaaatgccggatggttcaaaagcgttacgttttgatcaagtggcttttgctgcctttgaactatatattttaaaacgtccgggagcagaggaaacttactcaccggaagagcaagcagaagccaaagcctattttgatcaaatgagcgaagcggatattgcgaaattaacaaaaaatattattgctgggttaccgggatctgaagagggttatactcttgaggaatttcaagcacaacttgatcgctataaaggtatttctacagagaaattccgcactcatttagcctatttcttgaatgaaattgtgcctgttgcacaagaagtgggaatccgtatggctattcacccggatgatcctccacgtccaattctcggtttgccacgtattgtgtcaactatagacgacatgcaatggtttgtggatactcaaccgcttgccgctaatgggtttactttctgtactggttcatatggtgtgttagcagagaatgatttagtgaaaatggcggaaaaatttgctgatcgtatttactttgttcatttgcgatccactcagcgggaggaaaatccacgaagttttcacgaagctgatcaccttgccggtgatgtaaatatgtttggggtaacgaaagcattactcaccgaagaatatcgtcgcaaggcaaatggtgataatcgcttaattccaatgcgaccagatcacggtcatcaaatgcttgatgatttgaagaaaaaaactaacccgggttattctgcgattggtcgcttaagagggttggcagaatttcgtggtttagagttggcattaaaaaaagtgtattttaatgactaattaaagaataaaggtactaagtgtcttagctgggaagtatagttctagacatggtgtgaaagaaacccgacaaattgtcgggtttctttcatctaaaagagaggtctgttttatactattttttgtttgacagaagaataaattacgccggttatcaaagacacgatgctacttacaacaagataaaaagaatctgttaatcattttaggttattagtatattattttacacaaagttttaaaatttgttcgctaccctgcacgagatattgatcatcttcagatcgtactcgattatttttcaagtctaacatggcatcataaataccttgtgtcagacttgcttgatcaagatgactccaacaagttgaacttaatctattaaagttggtttgtaatccgaaagcaaagagaataccgctataataagtatgcacatcgctgtctaatccattgcgttgaaacagtttttctttaatttgattgatcgagactgaaatttttgcggagtaccaatcttttacaccactggcaaaagcgttcacatgatattctttgttcacacgaccttggtaactttgtactgtcaccgcataagcagtggcataagatttttgatctattttatcattgtccaagttaatcaccgtttttatattgttttccgatgaggtataagaagtaacagattttaccgagcaagctgaaatcagcccaatacataaaaataaagatactcttttaaacataaaattattcccaaagaaaaaataaattaattgtacagacggatcggatttaagccaacaaagaaaattcaccgcactttctcatttattctcaatctttaaaacaaaatctaaaaatgctatattgtacgctgttttttctgactaacctcaattatttatggctaattatcaagatataacatttgcccttgcgggtgtgtgccaagcggcaaaattagtacagcaacttgcaatgaacggtacggttgaccaagaaattttgcgagctggtttaagtacattgttgcaaactgcaccggaagatactttagccgtttatggagggcagaaaagtaatttaaaattggggttggaaaccttaatggaacaattaaacggcagtgatgtaactttaaatcgctattggttaggacttttggctttagaaggtaaattacataaaaatgcacaagctaaatctgaactggctcgtcgtattcagtatttgcctacacaacttgcccattatgatttacttgatgaacaaatgttatcaactttagcttctatttatgttgatgtgatcagtcctttaggtgctcgtattcaggtccaaggctccccgctttatttacagcaattaatgacacaaaatcgtattcgagcttgcttgttgactggtattcgttcggcggtactttggcgacaagttggcggtacgaaatggcaatttttgttttcacgtcgcaagctggtagcaacagcacaacaaatttattcatctatttaactgttcttaggagtaattcttttatgcaattcaacgcattgaccgcactttccccgatagatggtcgttatcaagacaaagtaactgctttacgtggcatttttagcgaattcggtttattgaaatttcgtgtaactgtcgaagttcgttggttacaaaaattatctgcaacaggcactattcaagaagtttcttctttatctaaagaggcaaacgattacttaaatcaattggtagaaaatttcagtttgcaagatgctgaacgcattaaagaaattgaacgtattacaaatcatgatgtaaaagcggttgaatatttcttaaaagaaaaaagtctggcaatacctgaattagtggcgattagtgagtttatccattttgcttgtacttcggaggatatcaacaatctttcttatgcgttaatgttaaaaaacgcacgtgatgaagtacttttacctgagtggcgtaagttaattgatgaaatcactcgccttgctacagagtataaagcaattccattattatcccgcactcatggacaacctgcctcacctaccacaataggtaaagaaatggcgaatgtggtatatcgcttacaacgccagtttaaacagttacaacacgtggaaattctaggcaaaattaatggtgcggtaggaaattataatgcccatttatctgcctatcctgagattgattggcatcaatttagccaagaatttgtgacctcattaggtttaacttggaatccttatacaacccaaattgaacctcatgattacattgcggagttttttgataatgtagcgcgttttaacactattattatcgattttgaccgtgatttatgggggtatattgccttgaatcatttcaaacaacgtactattgccggtgaaattggatcgtctaccatgccgcacaaagtgaatccgattgattttgaaaattcagaaggtaaccttggcttagcgaatgctgttatgtcgcatttaggtgcaaaattaccgatttcacgttggcaacgtgatttaaccgactcgacagttttacgcaatttaggtgtggggcttggttattgtttaattgcttatgcggcaacattaaaaggtatcagcaaacttgaggtaaatgaaccgcacttacgtgaagaattaaatcaaaattgggaagtgctggctgaaccaattcaaactgtgatgcgtcgttatggtattgaaaaaccttatgaaaagctaaaggagttgacgcgaggtaagcgtgttaatgcagaggcgatgcgtgagtttattgagaagttggaaattccagctcatgaaaaagctcgtttaaaacaacttacaccggaaacgtatatcggtagtgcaattagtttggtggaaaaattgtaaattcggtgtgtttgtcttggctattgccccttagtataaaagcgtatcttagctacgtaaggggcaaatttaagacacttcagataagatttaattcaaaaatagacttttgccggttaagtttaaaaccttctcttattaataattccggttgttgcagattttgttccatgactaaaagtgtcgattgagtataactgacaaattcttttgcttttgcaataagtgcggtgtaaatttcactcttattttgggtatttttgacaaaaatatcatttaattgccaatagcgttgcagttgtaatgaagaaaagcgaggatagagttgaataaagccgacagggttttgctgattatcgacggcgagaaagaagatactttcactaaatcgaattcggtttgataaaaaaataagagttcgctccggattttctatcatattatgggtgaggcggtattgttcaaataaagacaataaagcgtccaaattccatagttcagctttaaatattttcatttctcaataattgttcaaaatttatgaaattcatacagtagattttatctttttaatacgaaataatcatcttttatgaaaaattttttatggatacaggaaaatttttgcaaaaaagagtatagtactgacagaatttttttattaattattatggagaacataaaatggctcgtcgtcctttagtcatgggtaactggaaattaaatggtagtaaagcctttacaaaagaacttattaccggtttaaaagatgaacttaatgcggtgtcaggctgtgatgtggcaattgcaccgcctgtcatgtatttagcggaagctgaagctgcactggtcagcagtgatattgctttaggtactcaaaatgttgatttaaacaaacaaggtgcatttaccggtgatatttcaacagaaatgttaaaagactttggtgtaaaatatgtcattatcggtcattctgagcgacgtcaatatcatcatgagagtgatgaatttattgcgaaaaaatttggtgtgttaaaagatgctggtttagttcctgtattatgtatcggtgaaagcgaagctgaaaatgaagcaggcaaaacggaagaggtttgtgcacgtcaaattgatgcggtgatgaatacactaggtgttgaagcatttaacggtgcagtaattgcttatgaaccgatttgggctatcggtacaggtaaatcggcgactccagctcaagcacaagcagtacatgcctttattcgaggccatattgcaaaacaaagccaagccgttgctgaacgggtaattattcaatatggcggttccgtcaatgatgcaaatgcagcagaattgtttactcagcctgatattgatggtgcattagttggcggtgcatcgttaaaagcgtcagcgttcgctgtcattgttaaagcggcagcgaaagcaaaaaactgattttagttcattcataaaaagtgcggtaattgataccgcactttttagtattcatattagtattcataatttctcgttttcttaatgtctaaaatttatgtggtcttttttttatacctcaataatgtactgtattcagccatttgtcttggtgtataaccttatacgcagttttaagtcgccgaattatcgaaaacgtattttagaacgttacgctttttatccttcgctgactgaaccgaagccgaatggggttgtgattcatgcggcttctgtgggggaagtgattgcggcaactcctttagttaaaaagatacaacagcaatatccacatttatctataacgtttacaacggtgacaccaacgggatcagatcgtgtcaaagccgcttttggtcaatccgttttccatgtttatttaccttatgatttacccgatgcaattttgcgttttattgattttgtaaaaccgaaaatgtgcattgtgattgaaacggaaatttggccgaatttaattaaacaattatatttacgagatattccttttgttattgctaatgcaagattgtctgaacgttcggcaaaacgctatggctgggttaaagcacaattacaaaatatgtttagtcagattagcctgattgcaccgcaagacgaggtaagcctgcggcgttatattgatttgggctacaatccgtcaaaattaaaattgacgggaaatatcaaatatgacttagtggtgaatgatgaattagtgcaaaaaattaccgcacttcgtcaatcttggagtcaaaatcgcccgatttggattgcggcaagcacccatgagggcgaggaagttatgattttgcaggctcatcaaaagttgctaaaaacttatccgcagttgttattaattttagtacctcgtcatcctgaacgttttaatcttgtcgcagagttaattgaaaagcaaaagcttaactatattcgccgttctgcacatgttaatcccgatttattaacacaggttgtacttggagataccatgggggagttgatgttaatgtacggtatttccgatattgcctttgtggggggaagtttagtcaagcatggggggcataatcctttagagcctctcgcttttaagttacctgtgattagtggtcaatatacttttaattttccggtggtttaccaaaacttatcagaggttcaaggggtagtgttagtcaatgaaaatagccaagagctggaaagtgcggtaaaaaatttgttatcttctcctgaattatgtgaacgctatggtaatgccggttatgaagtattggtccaaaatcgtggtgcattacaacgactatttgaattactacagccttatttggagaaagaataatgacaacggttatttatcctggcacttttgatcctattaccaatggacatatggatattattcagcgtagtgcggtcttatttagcaaagttattgttgctgtggcaaaaaacccgagtaaacaacctttatttaatttagctgagcgagttgaattagttcaattgtctgttgttcatttaggcaatgtagaggtaattgggtttgatgatttattggcaaatgtggttaaagcaagacaaattgatgcgattattcgaggggtacgcacgacaatggattttgaatatgaatcacaacttgcacatttaaatcgtttgttgacgaatggtgtagaaagtttatttttacccccgaccgagcaatggtcttatgtttcttcaactattgtacgagatatttttttacatcaaggtgatgtgtcccgattagttcctgcagcggtattacgagctttagaaaagcgggctaaataatttgatgagattttattaaataatccttacattatgtatgtttaaaacactaaaactaaataggaaataatgaatgttgaataaaatttttgtgtggtttgaaagtcgtttaaatccttatccggaacagacattcaatcacctacatcaaggtctgtttcgatttatttggtcaaatttggaaggaatgaaaaaatggattttcctacttgctttcttatcgttcggattgggggcaatggaggcaattcttttccaatttatgggcgttttggtggaatggctcagtcaatatgacgtgcaaactttatgggtagaaaaaggtgcttatttagttgggatgttgattttattgctatttagcattatatggtcttttttagcatcagctacacgtttgcaaaccttacaaggtgtttttccaatgcgtttgcgttggaattttcatcgtttgatgttggggcaaagtttaagtttttatcaagatgaatttgccggtcgagtgtctgcaaaagtcatgcaaacagcgttggcattgcgtgatacagtgcttactttggcagacatgatggtttatattttggtctattttgttacctcaggtattgttttagcagcattagatatatggttattagttccttttgttctatggctaatagtttttgtggttattttatggattgttattcctgaactggctaaaaaagcagaacaacaagcggactcaagatcattgatgacaggtagaattactgatgcttatgccaatatttccactgttaagcttttttctcatggtgcaagagaggcagcttatgcaaagcgatccatgcaagattttatgatgactgttcatgcacaaatgcgtcttgctacttccttagatactctgacttatagcacaaatgttgctttaaccttgagtaccggaattttagggattgcgttatggggaaaagggttggttggtgtgggtgcaattgctactgcgttggcaatggcactaagagtgaatggattatctcgttggattatgtgggaaatggcacgcttgtttgaaaatatcggtactgtaaatgatggtatggcaacactgacaaaaccgctaactattgtggataaaccggacgcacaagatttggagattaaacaaggaaatattcattttaacaatgtagactttgcttatacaccggataagcctttactaacaaattttaatttacatattaaagccggagagaaagtagggctgattggtcgttccggagcaggaaagtctacaattgtaaatttattactgcgattttatgaaactcagcaaggttctatcactattgacgggcagagtgtcgcagatgtttcacaagaaagtttacgtcgccaaattggtttggtcacacaagatacttctttattgcatcgttctgttcgggataatattgtttacggtcgtccggaagcgacagaagaagaaatggttgaagctgcaaagcgagcagaggcggcggagtttattccatttttgagtgattctcaagggagacaaggttatgatgctcatgtgggagagcgaggagtaaaactttccggggggcaacgtcagcgtattgctattgctcgagtgatgttaaaagatgcaccgattttgttactggatgaagcaaccagtgcgttagattctgaagtggaaatcgctattcagaatagtttggacaaaatgatggaaaataaaacagtgattgccattgctcatcgtttatccacaattgctgccatggatagattaattgtattggatcaaggacgaattgttgagcaaggcactcatactgaattgctggagaaaaacggtttgtatgcaaagctttggcaacatcagagcggtggatttttgagtgaatattagtcaagattttaggattaatcaaagacgctaaaaaggcggaaatgtaagatttcaaattccgccttttgctcctcaaacagtgttatttaaatttgtcggcataagcagagctgttgatccactgatgatcttgttcccaagtaaatttccatttacgtacaggtcccgccataacattaaggtaatagttgttataaccggcaatagtggcaactgggtgataaccttttggtaccagcaccacatcgccatcatataccgccatacattcgtccaaagtgcggtcgtccgtatagacacgttgcagagcaaaaccttgtggtttatcaaaacgatgataataactttcttctaagtaagtttcatcaggactatctttttggtcatgcttgtggcttgggtaggaactggtatttccttcatcagtaaatacttcaaccactagcaaggcatctgccttttcggtttccggcaagatattgtgtacaaggcgtttgttattaccaaaaccacgtcgttctactcccacttgttcaggggtaattaaacgtacaggcaagtcaccgttacttggtgctcgacaaacagccaactctaaataagtttcagctttaatttctatttgttgatggtgtggagcgtacaccgaataaggcggaattttctcaaacggtgtagttcgattaccaatattattatatgtttcaccgccagctgagacagtggctttaccacttactaaaacaaaacaagtctcagtagtttctgtattaaaacttaatgtctgccctgcttgcaaatgatacatttcaaaaccgacatattcccaacctgcactttttggtgtgattttttgtacttcaccatttgcagcaggattgtctttgcgtgatttagataataagtaactcatattttccccaaagtgatcatattgataaaattttgccgaaatcataccgcacttagtaaatttcgctatgaaaaatatataaaaaccagatgtagatcacaaaataattattttacttctattagaatttgataaaaatgttttatttatgattttttttgcagtatataaactaggcgttttataagatttagtagtatagaaatctttgttaattaaaaataaaggagttttgtatgaaaagctttttgcaaaaatatgggtttaccccagcctcattttttcaactcattctgatcactgttaatgcacaattgatttatgctttttgggatattcgtaatagcgtacctggtggttttcctgccgctttaggggtaacggatcaacaagccggttatttatattctatgcaaggacttgtaattattttagggactattgctttaggttgggttggtgaccgtttttcaattcgttctattatgttgctatctacggttggtgtgggtggaatttctttatttctaaccctctcatctccaggacttagcatgcctgtgttactggcttgtttcttctctatgttattttttagtgaggtattatttaaaccggctaatttcaaagcattaagaatttcaaccacggaaaaacatcaaggtatggtgtttggattatttgagtttggtcgtgggttgcttgctttccttatctccttgttatggacggtgatgctttattataaagtcggtccgaaggcaatgatgatgacaagttgtattattgttattattactggtattgcagtgttttttattgtacctaaagatcaaaaagtcggagatgaagatactcaagttaatacgaccaaagaagctattcagggtgttgctcgtgtagctaaattaccggttgtttggattgccggaattaatgtgttctgtatttatggtgcgtttgttgccgctgggacctattttgcccgttttttacaaggtggatatggtacaagtgcggttgctgcggcagtttttgcaacagtagttattgcattgagaatgttacctttggtttcttccgttttagtagaaaaagtctttgcttctaccgcacacttcatgcgaatgatgcaaattattttagtggttattctttctgtaattggaattatcttttttaccaatcatccagatatttctttatatgctgatggttatattccagataataccccggtaggactcatttcttccagtatgttctggacactggtagttcttatgttatgtgcatcagcttgtatcttcatgattcgaggtgtttattatgccccaatcggtgagatgggggttgataaaaagcattcctcagcagcaatgtctttcgccattactattggctattttcctgctttattagcaccaattgtattaggtggcttggttaaatcaccggcaaaagatgctacaggacaaattatccgctcttatttaactgatacgcaagtgttagcttgtgctttctttgggcttgcgattcttgcattaatttctgtttttatgtcacatactttaattaaaatgaaacagaaacagcaattaaaaactagtaatcaataggcggttttttatgaatggtcaaaaaataataggaagtcagtgtattacgcaatgtaatcccgatcttcgcattaccgaattgattattccaggaactcatgactctgccacatcaacgtgttatgaacgttattatcgaacacaggatttatcaatagcggagcaattggattgcggtgttagatttttagacattcgtttacgcaaagaaatggttgcagcccatcgagaatgggttagtgatattcgagcagaggaaatttttgaaaagtgcggtgagtttttacaaaaaaatccacaggaattcgttttaatgcgtattcaaaatgcaaatgaacggaaagatgattttcctgaatatggcgaagcgttgttgtcaaaagtacagcaatataaatctttgttttatgcttgggagcattctcaaattgttcaagatggcaatccaaaatggccaactattgcacaagcggctggaaaaattgttccgatcgaatgtgctccgccaagtatgtcaatcaacaaaataaacggtgaattatgggcagccaattggcatgataattcgcagattttgttacaagacttgtgggatggtccgacagtagaagaaaaatgtgtagcaattaaaacgctgattgaaaaaggcagagaggtacactcggacatactgttgttaaatcatattagtgcaactaatggtgaattgcagtatccagatgcttatgcagcatatttgaatgaatactctagtcgattatggaaacaattggcgaaacgtagttttagaggtgtgcagatttatgattttattaatccttctatctgccaagaattgttgcgattaaattttgattagttgagttgatagatttagcaaaaatcaaatctagatcacaaaaatgaaataaatatttcgttttcaataaaatgaattgaaaattttattccattgatctactctaaagacgtagcaagaaatgctttgtgattgagcaaaaatacttaaggagaaaataatggaaacggttttgaactttatcaatggtaaacaagtagcaagtaaaggtactaaagcttggcctatttataatccagccacgggtgagcaaattcgccaagtaatgatgagtactgcagaagaggtaaatgaagcggttgaagttgcacaaaaggcatttcctgcttgggctgcgacttcgccacttcgtcgtgcccgtgtaatgtttaaatttaagcaattgttagaacgtgattgggatgacttagctcgtttaattaccgaagaacatggtaaagttttctctgatgcacaaggtgaactaactcgtggtttagaagttgtggagtttgcttgtggcattccacatttagtaaaaggtgaattttctgaacaagccggtcgtgggattgatattcattcagccatgcaacctttaggagtttgtgtaggtatcacaccatttaattttcctgcgatggttccaatgtggatgtttccgattgcacttgcttgcggtaatacatttatcttaaaaccggcgaaagccgatccatctttatctattcgtttggctgaattattaaaagaggcggggttaccggatggtgtgtttaatgtagtgcatggtgatcgtcaagacaatgaaattttattgcgtgatcctcgagtgaaagctgtaagctttgtgggttcaactacggctgcggcacatgttcatgcgattggttcggcacatggtaaacgtgttcaagcactgggtgcggcgaaaaatcacggtttagtgatgcctgatgtagatattgaagcaacagctaacgcactattaggtgcggcattcggtgcagccggtgaacgctgtatggcattacctttagcagtaaccattgatgatgaaacggcagataaattagtcgcagcattaaaaccgaaagtagaggcattacgttatggtcccggtctcactaaagaaggcgaaaaagaaaatgattttggtccattaattactcgtcaacatcgtgataacgtaaaacgttatgtagatataggtgtgtcagagggggcaactttagtggttgatggacgtgataaattccctgttggttacgagaatggtttctttattggagggtgtttatttgaccatgtaactcctgatatgactatttacaaagaagaaatttttggtccagtattaggcattgtccgtgcgaaaaatttccaagaggctatgaaactaattaatgagcatcaattcggtaatggtgcagcaatctttaccaataatggtgcggcagctcgtgaatttgcatatcaagtacaagcaggtatggtgggcgtgaatgtgccaattccggtgccgatggcattccattgtttcgggggatggaaagaatccgcttacggtgcattaaatgcttacggtccagacggtgttcgtttttataccaaaatgaaaactgtaacaactcgttggccagagaaagatctttcatcacaagcagcattcagtatgccaaccctataagctagacaacagaataaaaatttaagttaatgtaaagaagatagttttttagctatcttcttttgcaagaaaaggaaatgaaaatgaaaaaagtccgagtcggtttaatcggaacaggttatattggtcgttgtcatgcgattgcttatgcacaagcaccgacagtttttcctcttgaggctgaattggttttggaatatttagctgaaatcacaccagaactggcacaacaaaaagcacaagaatttggttttaatcgttcgacaggtgactggcgagatgtagtatccgatccaaatatagatgttgttgatatttgtacacccaatttcttgcacaaagaaattgctttagccgctattgctaatggtaaacatgtttattctgaaaaacccttagcattaaccgcagttgatgcaaaaatcatgtatgaggcggcaaaaaaagcaggtgtcagaacccttgtgggatttaattatattaaaaatccgactacacaacttgctcgtgaaattattgagcgtggtgaaattggtgaagtaatccatttctatggtacgcataatgaagactatttagcatcagatacgacacccttagactggcattgtgttcgtgaaaaagcaggacttggtgcattaggtgatttggcagcacacattgtgcaaatgtcacaatatttagtaggtagcgatattgaaaaagtgatcggtgatatggagacggtagttaaagaacgcccaaatccccaaaatcttgcagagcgtttaccggtagaaaacgaagatcaagcaactgctatggtgcgttttgcaaacggttgtatgggaaccattgaaacgtctcgtattgcttgtggacgtaaaatgggattgacttatgtaattaccggaacaaaaggtacaattacctacacacaagaacgtatggcagagttaaaactctatcttcacgatgaagatcctgctcgtcaaggctttaaaacaattttgacaggtccgttacacgcagattataaaaatttctgtgtaagtgcgggtcatggtattggttttaatgatcaaaaaacggttgaaattcgtgatttagtgaatggaatagcgaataatcataatatgtatcctgactttgaagaaggttttaaagtttctcgtgtattagatgctattgcacaatcttgccaagaaagacgctgggttaacgtgaaagaaattgcgtaattttcaccgcacttttataagtatttaaaaaggtcgagttgaatgactcggcattttttaggtataaatttaaaatgttgtttatctctaatttttaaaaatttttccctcaaaaagtagatcttgttcacaaaattttaacttcatcattgctctgtatcttgataaatgttacatactgttttaaacaatttatttcaaattgttttatttttggaatttatatttcttcaagtggaatatagctgtatttcagaatagtgattaactcaactttccaggagtagcgttcttatgaagaaaacattattggctatgttatgtggcggtctattattaacctctcaagctgtaatcgcaaaaaattatgtcattggtgcacctatgaactcttttgcggataaatggcaaacttatcttcaagatgccgttcgtgattttgatgaaaaacatgatgatgtgcaaatcaaattggctgattcaaatagcgatcccaatattcaagtcaatttagttcagaattttatcgaccaaaatgttgatgcgttacttgtggttccaacggatccgacagtagtaaaacgtattggcgtgttagcaaaaaaagcgggcattcctttaatcgtggtgaaccgtaaaccaaatgatgagcatatgcaatatgtaaccagctttgttggttctgatgaaattgaaggggggcgaattcaaggtaattttattgtcaatactctagccggtaaaaatgcagagagtctcattttactcggaccattggggcaagatgcagtcactaaacgtactcaaggtaatgaggaaatttttgctcagcacaagaatattaaagtagtgagcaagcaagaaggtagatgggaacgtgaccgtggtttagctattgcagaaaacgtattggcggggaataaaggtattaacgttattgtgagtaacaatgatgaaatggctattggtgcaattcttgcaactcgtaagttaggtatcaaagacgaagacattactatcgttggtttagatgcaactcccgatgcgttagagtatttaggtaaaggtttggatgcgacagtattccaatccgcacaaggtcaaggttacaccggagctgaaatggcttatttagcggctaaaggtgaaaaagtaccaagcgttaaatgggttccttttgagctagttactccggataaaaaagaagaatatcaagcaagatataaatagacgcttcttaaccaacacaaagggtagtgtaatacctaccctttatcttgagcaaatgttgatcgttatcatctagagacaaagttatgttcaaaaaatcattgtttattttattgggagtagcgtcgttgttttcccccattgttacggcaaaaaatttaaccgttggcgtggcgatgtatagtctttcagataaatatcctacctatttgcaagatgctatgaagaaatttgatcaggagaaagcggatgttacttttcgttatgctgatgcaaattcagatccggcaagaatgttaagcgatattgaaacatttattgattctggtgtagatgctttgttagttatgccgacagatagcgatattattaaagctattggtgttaaggcaaaaaaggcaaaaattccgttagttgtggtgacaaataagcctaaagatgaggatatgaaatatatcaccagttacgtagggtcagaagagattactggtggtgaaatgcaggcaaactttattgtagaacaattaaaaggtaagccggcaaatgcgattattttaatgggacctctaggttgggatgctcaaattaaacgcactgaaggaaatgaaaatattctgagaaaacaccctgaaattcaggtgatcagtaaacaggaaggtaaatgggatagagcaaaagcaattgatattacagaaaatttgttatcaggtagtcaaaaaattgatgtagtgatcagtaataatgacgagatggcaatcggtgcactccttgccgcccgtaaaaaagggattgcagacgaggatatgttgattgttggattagatgcaacacctgatgcgttagagtatttaggtaaaggtttggatgcgacaatttatcaatctgcttccggtcaagggcgtaccagtgcagaaatagcgtataaagcggcaaaaggtgaaagtgtacctaagttgaactttattccttttgaattggttacaccggataaaaaagcacaatatattgataaatatagatgatagaaaacagtaaaaattaaccgctctttgttgttagaaattaccgttattaatacgacaataaaaataaggagttctaaatgaatgatttgagtcgttctccatatattttagagatgcggaatgtatctaaaacattccccggcgttaaagcattggacggcattaacttaaaagtcaagcgtggaaccattcatgccttaatgggggaaaacggtgcaggtaaatcaacgttaatgaaaattctctacggcatctatacgccggatgccggtggagaattaattttagatgataagccttttaaaccgagtgcaccgattgatgctattcgcactgggttgactatggtaccacaagaaatttctcctgcgggtaatttaactatcgcagataatttctatcttgggcgagaaattactcgtggtaaattctttttaaatcaaaaagaaatggattgtaaaacagcggaaatcttaaatgaattgggtattccgatggatgtaaccgctaaaatgtcagatgtttccgtagcgaaggcacaattggttgcgattgctaccgcagtttctaatgatgcgaaagtaattattatggacgaaccgacaacggcattaacagaagtagaggttgaacagctttataaaattattgaaacggtaagacaaagagggatttcaattatctttatttcacataaattagatgaagttttccgtgtttctgatgaaatcacagtaattcgtgatggtcaatatgtaggtacgaaactaacctcagaagtaaccaaagatgaattgatttctatgatggttggtcgtgatatgtcagaaatgttccaacgtgaacgtattgttatttctgatgaagttgtactcgaaattaaaaacttctctcgtgcaggcaaatatcatgatattaatttccaagtgcgtagaggagaaatctttggtattgccggtctagttggtgcaggtcgttctgagattgtagagggattgtttggttataaactggctgatagtggtgaaatctatgttcacggcgaaaaagccgatattaaaaccccgttagatgctatgaaatacaaaattggctttgtaacggaagatcgtaagttaacaggactgtttttaaatttaagtattactgacaatatgattatgcctagaatgtccccttacttggaaaattttttagtgtcggtgacaaaagcacagaagtcagcaaatgctcaaaaagataaattaaaaattaaagcaccaaatgttgaggtcattaccaataatttatctgggggtaatcagcaaaaagttttattggctcgttggttattacttgagccggatattttaattttagatgaaccaacaaaaggtattgatgttggggcaaaagctgagctttataaactcatggtggaattagcaaaacaaggtaagagtattatcatgattacatcagatatgcttgaattgctttcgatgagtgacagagtgatggtaatgcacgaaggtcgtgtagccggaattattccacaagaagaattgactcaagaacgggtgcttgaattagcatccggtttaggtcaagtataaaaagatttcccctagaataacaatcgaggtatttattatgtcaaatgctacgcttaaaaaaatattgaacgcctatggaatggtgtttattttaattgccttatttttagcattatctgcatcaattgatggtttcttttccgctcgtactgtttggagtattattgagcaagtttctatgtttgggatcattgcaattggagtaacctttgctattatcacaacggggattgatttgtcctctggttcaatggtagcgatgacttctgttgtggctgcttctatcgtaactggtggcgatacagtaagttcggcattacttgcttttgcgatttcaattgtattaggtgctgcaatgggggctatcaatggtagtttaaccgcttttggctctatccctccgtttattgctactttaggtatgatgattattgcccgtggtggtgctcaactttattcttcgggtcgtccaattgatgcctcttctgaagcatttacttggatttctgatgttgatttctttggattacccggtttagtacttgtttatatcgtaattgtcattgcttcacacattttactgagccgttcaacatttggccgtcacgtttatgcagttggtggtaatttaaacgcagcaaaaatttgtggtattaatacaactaaaacattgattttggtctatgttttcgccggtgccttgtctggactggtgggtgcattactggcagctcgtacttatgcaggtaacccctcttatggtttatcttgggagcttgatgcaattgccgcggcagtgatcggtggggtatcgctaagtggcggtattggtacaatccctatgtgcgttatcggtgctttaattattgggacaacaaacaaaggattaaatatgctgggagttgatccatattggcaacaaattattaaaggtttgattattgttgttgcggtattaatcgatacattaaaacgccgtagaaaagcaaattaagcaaaaggttacaagaaaaaaatagcaattgtatagttgctattttttttgtttgttggggaagtgcggttagaaaaatttgatcagctccacaaaaatgaaatttatttttcatttttattttatttgaaacgaaaatatgattatatagctacaaatttcaattatctgatttgggagatgatgatgaagacagtgagattaacggtagctcaagcattagtaaaatttcttgataaccaatatattgagttcgatggaaaggtaacaaaattcgttgaaggcattttcgggatttttggacatggtaacgtgctgggtttaggtcaagcactggaacaggatagtggcgaattgattgtgcgtcaaggacgtaacgagcagggcatggctcatgtagcaatagggtttgcgaagcaaaaattacgcaaacaaatctatgcctgtacttcatctgttggtccgggggctgcaaatatgattacagcagctgcaacagcaacggcaaatcgtattccacttcttttattacctggtgatgtttttgctactcgtcaaccagaccctgtgttgcaacaaattgaacaaacttatgatttaagtattagtaccaatgatgcttttcgtgcggtaagtaaatattgggatcgtgtaagtcgtcctgaacaattaatgacagcttgtatcaacgcaatgcgtgtattgactgatcctgcagaaaccggtgcggtgacaattgcattgccacaagatgttcagactgaagcttatgattttcctgagtattttttacaaaaacgtattcatcgcattgagcgtacgcctccaacggaagcgatgctacaagatgctttgaccttaattcaaaatgcgaaaaaaccactaattatttgtggtggtggagtgcggtactctgaggcggcagagcaattaaaagcctttgctgaaatttataatattccatttgcagagactcaagcgggtaaaagtgcggtagtttctgagcattatttgaatgttggcggtataggtgtaacaggttgtgtagctgcaaatttattagcaccggaggctgatttagtcattggtattggtacaagatatactgattttacgacgggatctaaatggattttcaataatgacgaagtgaaattcttaaatatcaacgttgctcgctttgatgcttataagttagatggtgtacaagttacagctgatgccaaagaaacgctagaaaaattaaccgcacttttagctacaacaggttatcaagcccaatggggtgataaagtggcacaggcaaaaaaagcgttggaaactgaattagagcgtgttcacaatataacttataccgaagattttgtacctgaaattgatgatcgtttaaatcgtgaggcggtttatgctgaatttatcggtatgactaaatcttgtttagcacaaacgagagtattaggtattttaaatgaaacattaggtgaaaatgatgtcatcgtgggggctgcgggtagtttaccaggagatttgcaacgtatttggcagtctaaaggcgaaaatacctatcacctcgaatatggttattcttgcatgggttatgaagtcaacgcggctttaggtgtcaaagttgcggagcctcatcgtgaggtttatgccttattaggtgatggatcttacatgatgttgcattctgaactggtaacgtcaattcaagaaaatagaaaaattaacgtaatattattcgataatatgacaaacggttgtatcaataacttacaaattggtcatggtatggacagttttgcaacggaatttcgttttagaaacaagaataccaataaattagatgggggctttgtaccggttaattttgctatgaatgccgcatcttacggttgcaaaacctatcaagtaactaccgaagaagagctacgattggctttggctgatgcaaaaaaacaacaggtttctactttaattgatattaaggttttaccaaaaacgatggcgaagggatatgacagctggtggcacgttggtgtggctgaggtgtcaaataaagctgaaattaatgctgcctatgaagattctgttgctcatattgaggtagcaagacgttactaatttaacttgataggctcaatattgagcccatttatcatgaaattcattcattctttttaagaaggacaacagtatgaaagctgaaaatgtaaaattgggcattgcaccgattggttggacaaatgacgatttaccggaaattggtaaagagaatacttttgaacagtgcgtaagtgaaatggcattagctgggttcaccggtagcgaagtgggaagtaaatatccacgtgatattgacgttttgaaacgtaaactggatttacggggtatccaaatttgtaacgcatggttcagtacattctttgttgatggtaaaaaagaagaaactatcaaaggttttatagagcatcgtgattttttacatgctatgggcgctaaggttattggttgctctgagcaaagtcgtagtattcaaggtcagaaaaaagcaattttcaaagagaaaactattttcacggaagctgaatggcaattgctagcggaaggttataatgagcttgcaaaattagccgcagaaaaaggcatgaaggtatgcttacatcaccatatgggaactggtattcaaacacccgcagaaattgataaatacatggaaatcactaatgatgatgtgtatttattattcgattcaggtcacctttattattcagaaggctcacaacaagttatgctggaggtattagaaaaatatattcaccgtgttgttcatgttcacctaaaagatgtgcgtgatgaggttgtggcggaagtaaaagcaaatgatcttagtttcttggaaggggttgttaaaggtacattcactgtgccgggagatggtgtaattgatttcaaaccgatttttgatattttagaaaaatatgattataaaggttggatggttgttgaagccgaacaagatccggcaattgcaaatccgttagaatatgcaattaaaggtcgtcaatatatcagagaagttgcaggagtttaaaatgattaaagtaggtattattggtgcaggtcgtattggtcgtgtacactcagaaagtattacaaaatatgtaaaatgtgctgaaatcaaagcgatttctgatgttcgtgttactgaagaattaaaagaatgggcaaagggaatgggtattccgaatgtctatgaagactataaattaattttacaagatgcggagattgatgctgttttagtctgttcttccactaatacgcatgcaccgatttctattgaagcggctcgtgcgggtaaacatattttctgtgaaaaaccaattgacgcagatgttgatcgtattcaacaagtattagcagaagtggaaaaagcgggtgttaaattccaagtcggttttaaccgccgttttgaccataatttcaaagcaattaagaatgcggtagtcaatggtgatattggtgaaccccacgttattcgagtcacttctcgtgatccagatgcaccgccaattgaatatgtaaaagtgtccggcggtatgttatttgatatgacaatccatgattttgatatggtgcgttatttgtccggcagtgaagtaacggaggtatatgcggcaggaggtgttcttgttgatccgaaaattggtgaagcgggcgatattgataccgcagttattaccttaaaacttgcaaacggggcaattgcagtgattgataatagccgtaaagcagtttatggttatgaccaacgtgcagaagtattcggttctaaaggtgcgatccaaaccgcaaatgatacgccgtcaacagcaattttatctaatgtgaatggtgtcatcgcagaaaaaccaaaatatttcttcttagaacgttacatgcaatcttttgctgatgaaatggcgtgctttgttgactcagtggtgaatgacaaaccaacattagtaaacggtactgacggtttgcaaccggtattaatcgcaattgcagcgaaaaaatcattggatgaagggcgtcctgttaaaatgagtgaaatttcctagtttaaggagattgcacgaaaaagggcggtaaaattaccgctcttttagcttgtacttctgttacgttgccaaatctccgaaacagacctgtaatgcggtgattgcactaagtgcggcagtttctgtgcgtagaacacgcttaccaagtaaaatttcagtaaatccctgagtttctgtttgactaatttcttgtgcagaaagtcctccttctggacctattaacaagcgaacaccttgtgggggaatttcaggtaaggtacgaattgtatatttagctcttgggtgaagattaagctttaaggttccgtcttgttcagcacaccaatcttgcaatttcattaatgggcgaatttcaggcactatattacgcccacattgttcacaagcggaaatcgcaattttttgccattgttggatttttttctccatacgatccttatcaagttttactccacaacgttcagaccataatggcgtaattatgttgacccctaactcaacggatttttgaatagtaaactccattctttctccacgagaaatcacttgacctagatgaataaataaaggactttcacgattgtccaattgacgagagagaatgttaacttcaattgcttttttatttgtttgagtaataatggcagggtaaatatggttacttccgtcaaataattcaatttgctcacctacctgcatgcgtagaacacgccctacatgatttgccgcattatcgcttaattgacaagtttgttgattttctaaagaggttggatgataaattcgaggaatacgcatattatttaatgggttagttaattttgttgctatgataacagaaattaaaagtgcggtgaaattcaccgcactttttgtcattgtatttgttgacttgaaaaaataagtaattttaccttatttttttatatcaaatttataagaaataaatccatatagcgtccaaccgatgaatgttacgattgaaccgtatagcatagcttgctcacctgctgcgtataaggcatataaactatataacgaaccgatgaaggcaacaaatgtggtaattttagctttatttaatgctactttttctactttaagtaagaccattaatgcagccattgataacagataaggtattacgttggtcaccaccgccaagtctaccaagatgttaaattgtttgtttaaagatggactgatagtcatcagtgctaataaactttgaattgcagtaattgtaaccataccaataataggtgcgtttttactggtcacttttttgaagaatgctgggaaatatccttcttcggctgaagatttgaatacttgagcaatggtaaactgccagcctaataatgaaccgaagcaggacattaccattaagcccattaccactttacctgttgtttcttcaaacatatgtgcaaaagctaaaccgaacggtgctgttgaattagcaagttccaaattaggaacaataccggcaattacgttggtggaaacaatataaataaccgccgcacctaatgttccgccaagaactgcgataggaacatttctttcaggattttctactacatcagtattcgcacaagctgactctaaacctaagaaggcccataacgtcatagaaatagatacgccgatggcttcaaaagtgggaacgttatgtgggttccaagcactgacatacatttcaccactaaaccagaaccaaccaattaaacaaatccctacgaccggaataattactccccagatagtaaaagagctgatgttaccagtgattcttgccccaccaaaattcaaaacagttgctaaccatagtgtgaatatagtgcatagtgcaatggatatcggtgataaagtgacatttaatagctctgatccgtatccaacggcggatattgcaatcgcagtattggcaatgactagagaaactccataagtgtagtttgccataaagttaccggctttaccgaaagaatattccgcataaccacccataccgcctgattttttactgaacataccacattgagcaaaagcataggctaaagcagttgaaccaacagctgtgactaaccaagatacaattgagatagttccaatttcagctaattttgtcggtagcatgataatgcctgaacccatcatatttaccattgtcagtatagtgagttgtactacaccgattttattacttttttgagtactcataattttatccctctattaaagtgcggttatttgtaattaaccgcacttatttttttattatgcttcagttaatacatatccataagcacgtgtacgtccatcaggatctttttgtagatatacgccctgaatttccggtgcgaatccaggaagaacattaatgccttcttccagtgcaaggaaatattgttgtactgtcgtactccaacgttcaccgggaacaacacataaaacacctggagggtaaggtaatgcaccttcggcggcgattcttcccacaatatctgtcaatggaactaattcaattttgttacgaacaaattcgatattcgctttttgtgggttcatagcatattccggtagagttgtttttctaaacaagtcacgttgtagctgtttaacatttctactgacgtaaagattgtgcatttcttgacataattgtctgatagtgtagccctgatagcgttcctcattatttttgtacacagtaggcagtacatctttgagtaatgaattttgtttgatatgtttttcaaacgcagctatttgagcaactaaagtttgcatttttgtcaatgtttcagccggtgtaagtaagaacaaaatggagttcaagtcacatttttcaggaatgattccattttctcgcaagaagttagcaaggattgttgctggaataccaaagtcttcatattcccctgtttcaatgttaatccccggagttgtgagcatgaatttacaagggtcaacaaaatattgattatctgtataaccctcaaatttatgccatgtatcatttgcatggaaattgaaaaactcaagatcatttgcaatttctttagtatcgtgatcttgccattttttacctttcacataaggaggaataaatggtttgattaaagtgcagtgcttaagcattaactttcttgcctcgataccaacttctacacactcggcccatagacgtttccctgcaggagaaccttgaatttgagcgtttacatccagagtggcgaatagaggatagaatgggctggtagacgcatgcaacataaaggcattattaaagcgtttgtgattgcaatatcttgcttgtcctttaatatgtttgtcttttttatgaatttgtgatgtttgtgagaaacctgcttgttgtttatgtaccgattgtgtcacgataataccagggtcattttcatttaaatctagtaataatggagagcaatctttcatcattggaatgaattgttcatagccgacccatgcagaatcgaacaagatgtaatcgcataaatgtccaatacgttcaacaacttgtttggcgttataaattgttccgtcataggtacccaattgaataattgcaagacggaaaggacgtttctcttcaagtttttccggtgccacttctgcgattaattttttaagatatgcttcttcaaaacagtggttatcaataccgccgatgaagccgaatggattacgggcagtttccaagtaaacaggggttgcacccgcttgaattaaagcaccgtggtgatttgatttgtgattgttgcggtcaaataatactagatcacccggtgcaagtagtgcgttacaaaccactttattggaggcggaagttccgtttagtacaaaatatgttttatctgcattatatacttttgccgcatgttgttgagcatcacatggagcaccctcatgtattagtaaatctcccaatttcacatcagcattacaaatatctgaacggaaaatattttctccatagaaatcgtatagataacggccggctggatgtttgcggaaatattgaccgccttggtgtcccggacaatcaaatgccaaattacccatttcgacatattcgcttaacattttaaagaatggaggtaacattttttgctcataaagagacgcagctgtttcaatttgacggctatacaaattgatatcatagctgtttagatcttgaacatgataaacctgatcaaaatattcatcagaaagtgtttcaccttcatttaatacgacaaaaataggaatattaaattcagtcgtttttatttgttgaatatacttaacatcttcggcagtcaatattattgcacctatatcggtgaaatcagtttgatttaataaaactaattcacgagttgatgtaaaatatttttgcactaatgggctatgtgcgatttttaattttaacataaaagactcctttgtcttatttaaagaatacaaatcaccctctcacaataaatatagaaatagtgagatagcttacttttaaagttttataaattattaatataaacagtacgtgaatttttatatttatttaactataaaaaacacgaacacttattctagaattaagaacaaacacaggtttttatttatcaagaaaaaccgtataaagaatataaaaattctaggacaaaatattaataaagtagaaaaccgtgaaatcccctttatttaaagggaattaaatggaaaagaattgatatggattacttttagaatggagaatagcaaaagaaaaacaagaacgatgggacggtttcataaggtgtcgagtacgacgaatatgtgccatcaaagaacgccccttaatagggttatattcttgactataattgtggtctaacataatagcctccgaaatttgttttgcttatatagttttagtttaccatcgaagcaaattttgcgcctataaaataaaaagtcaataaattttattttttttttttttttttttttttttttgacggaggtcacaaaaattaaattttgttactattttatgttatgaattattttccttttttgatccaatatttaaatggagtgttttctaaatcactttttaataaattatgatccataaattgacaaaagctaggaatatctctagttgtggcaggatcatctgcaagaattaataatatttctccttcttgcatatggcgaatttttttgcgtaagagcattattggttcgggacaacgtaatccaattgtgtttagagtttgtgttacaataatatcagtcataataatttctttgttagaatagaaagcgtgtatgatagcgtccaatttctttagggtcaaaataagtaaagtatgaaatatcttattccccaaagtgcggttgtttttgaagaagaaattaagaagagccgttttattacttatcttcagcatgcagaaggtttggagcaggctaaagcattttggcattcaataaaaaatcaacatccaaatgctcgtcatcattgttgggcaacggtttcgttacaacccggtaattcgcaaggattagggttttctgacgatggtgaacctagcggtacggcaggaaaacctatgttgaatgttttattgggaagtggtattggtgaaatttctgctgtagttgttcgttactatgggggaattttgctcggtacagggggattagtgcgagcttatggaaatggtgtgcaacaagctttgcaattgttacagacaagtttaaaaatagaacgaaaaatttatcaactttattgtgcgtatcatcaggtcaattggttacatgttttatttgaaaaatataatattaggatcatttctcaacattttttacaggatgttcaatttgagttgggtataagtgatgataaactggcagcatttcagaatgacttatctagttattcagcaggacagttaagattattagaaaacaaataagagagaaaattgtgcatattttatctattctgcgtatagtgggaattctagtaacctgcttttccattacaatgttaattccggcttttatagcgttgatttatggagatgggggtggaaaggcttttatcttgtcgtttttttacaatctttcagccggagttgggttatggtggctatgtcgagcacataaggcaagtttacgttcacgtgaaggatttttaatcgtcacaatgttttgggttttgctcagtttattggcagttattccttttatgttgttcgatgagctaacattgagccttgccgatgctgtatttgagtctttttcagccttaactacaacaggggctacagtaattttggggttggatcatttgccaaaatccatccttttctatcgtcaacttttgcaatggattggtggaatgggattgattgtattagtggttgcgattattccattgcttggtattggtagtggtcatttatatcgagcggaatcttcggggccaatgaaagatcaaaaagccttgcctcgtattggtgaagtggcaaaattattatggtttctctattgtatattgactattttctgtgcgtttgcttattgggttgcgggaatgagttggtttgatgcgatttctcatagtttttctacggtgtcaaatggcggaatgtccaattacgacgccagtttaggttactttgacaatccggctatttatttgattagtgctggttttatgctgattagtggttgtaattttgctttgcatattcgagcattaactaattggaaataccaacctgtctggaaaatttacgcaagagatcctgaatttaggtttttctgtgcaattcaagggatatttattttcttattatcgttagggttatatctgacctatgaaaattattctgtttttgatgctttctcacaaggtgcgttgcagtcagtatcaatggcaatgacttcaggttatactttatttgatttaaatcagcttccggcttttttggggatgttactggtctttatggcaatattaggaggatgtgcgggatctactacaggtggtttaaaaatgattagagtgcttgttgtatggttacaaatcaaaagagaatttaaacatttagttcaccctcatttggttattccaattaaattggggaaaatgttattggcacagagagttattgatgggatatggggatttttaattgcatttttcttaacctattgggtatgtgtatttgcggttatattatgtggaatgaatgctgctgatgcgatgttgtctgtctttgccacactaacaaatgttgggccaggtttgggaataattagccaaagtttttcacaagttccggataatgctaaatatgtattttcttttgctatggcagccggtcgtttagaaattttttctcttttacttttgtttacgccgactttttggaaatcataatgaaaacattgattttatatttaagccgagagggtcagactaaaaaaatcgcagaatatataggcacaaaatttgaaaaaagtgcggtacaatctttgcttgatttttctggtgatttagctaccttcgatcgtattattattggtgcctcggttcgctatggtcattttgatcaaagactttatcaatttttgcaaaaaaataccgcacttttacagcagaaagagagcagtttttttggtgtgaatttgacagctcgtaaagaaaataagaatacaccggaaacgaatgtttatgttaggaagtttttacaacgtattcggtggaaacccaaatatgtaggggtgtttgccggagcgttgttttatcctcgttattcttggtttgatcggatgatgattagattaataatgaaaataacagggggcgaaaccgatgtaagtaaagaaattgaatatacagattgggaaaaagtagacgattttgtactaaaaattagacaaggtgaatgaaaaatcagcttttgattatatatttgaatttttttgcaaagattgcttgcaaggaagtgataattttctataatacgcctcctcctcttttagaggggaatgagaaatgaatatcatagattatttggaaaaattttaagtaatcacttgacatgaggtttcaatctcactaaaattcgaagccttgcatttttggtgcagtgtaaattgttctttaacaaactatcagacaaactgtgtgggcacttgtgagactgtattgataagagattaaaagagtaagataagtgcttaaactagagaaattcatagagaaaagatggatgaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatgaccctgggtggagacactcagggttttttgttatttgggataaggcggggaagagagaagagggaagaggaaactgggagaaaaaaagtaataaggtgataacaaggtagtcataaaaagtagggtaatgaagcagagtgaagaggtgcggtaggaaaattgtttttttttctaccgctctttttttaggtgatttatttttagcgatttgcttaatgcagaaaaacgatttgtgagagtttataaaaatgataacgaacaagtatttttacaaatgagcttagaatcaggtatgacagaagcatatttgatagaatctatcaagagattcatatcccttcaaactatgttttctgtgtttgtctcctttgggttgtaggtggtggacctggcggtgttgcattcggattgaaattggcatttggcgattatgtacactgcatttttgctgaaccgactcattcaccttgtatgctaacagcaagttatcgtcatgtgccagatgctgatttgcagggtgaatgggagatgactaaatttgtatttaataaaaaggaatttccgttagagccgaaaagcttgttttatgactggttatatttaaatgtgttgttttctgaacacaatacagcgttgagagaagatttttttcaaacgggttataacgcttttagtgatattgagtttaatcctgagaaatcgtttagttgtcaggcgcgtactttggcattgtgtgtatcgctttatgaaaataatgcgatataggcttttattcaggatcctgtgattttttcagcacaatattcattgtatcaaaaagtaaatcttgcacagcaatcagaacttttttaggagaaatttatgtttttatttcaaaatattgagcatattgagtatgtattcatataaactgatacattcgtcgctaagggtacaattatgtctgaaaatttctcaccactccaatctattgaacctgatctttatcgtttggcaaaagatgctggacatcacctacattcagatccacaatcttcactgatcaaattacgttgttttaccgagcaatttgtactattactctgtaagcagttgcatattgaattagttgataatgaaagcttatcagatcgtatgcgtaaagcagattttaaaacctatgttccaaaagagattcaacaaaaactccatttattgagaatagcaggaaataaggctgtacatacttctttctctcatctagatttttcagaagtggcagactgtttgcgtgaagcctatcttttaggaaaatggctctatcttaatcgcgttcctactacttgttaccctgattttatcctcccaagccctaatcacagcattgaacaattgcaacaacatattctttcattaaaagaagaaaataaaaaacttaatgaacatagccaaaaaataatagcagaaaatgcaaaactacatttatcatttacagaattaggagaaatacgccgagttcaagcggaaaaacttcaagaaaatacagagaaagtaaatttggagagtgacaaaacacttgcacgtttaaaaaaatacagactacgggattgttatagccaatttaaattaaccgatggacaaaaaacattagaggatcaattagatcagtttttagcagatccgaaacaacatatctttttattaaaaggttatgccggtacgggtaaaatctttattacccttggtttaaccgattatttagatcttattgaacgtagctattatttaagtgcacctactggaaaagccgctcgtgttatatccgaaaaaaccagaaaaggtgcatcgaccattcattctgccatatataacttggacaaattagtggaatatcaagatgaaaaagatccgaaaacgtataaattctataccgcattaaaagtaaatacagatatttctgattgtgtttatattatcgatgaaagttcaatggtaagtgatgtttatactgatggtgaatttatgcgttttggttcggggtgtctattaaaagatttaatggaatacattaatatcgatcaaaatgatcataataagaaaattatctttattggtgataatgcacagcttccgccgattggaatgaataattcaccggcgttggatagtaaatatttagctacaaagtaccgcttgaatagtctcgaatatgaattaacagaagtggttcgccaaaaatcggggagtggtattattcaaaatgcggtaaaaattcgagaatgtatcaataaaaaagagtttaatcgtttaaatatggatttaaattatcacgatattcatcaaatcgaggcgaaagacacgattcaaacttatttagagagttgtgggcataagataaatgacgaatcgatgattattgcttgtttaaatgccgatgtgcaaacttataatgaagcaatacgacaatacttttttccggataaatatgaaatttgtcgtggtgataaagtcatgtcattacgtaatcgtaaaattggtggggtgcgtattgccaatggggattttgctttagttagatgggtatcagatgaaacggaaacaaaaacagtgccattgaagaaaaaattagaaaatggcgaagtggagactaaggtaatagaactcaacttccgagatgttgagatcggttttagaaacactgatgggaaagcggtatttgttaaaactaaaattattgaaaatacgctttattccaaagatccacaattaagctcagatgaacataaagcattgtatatagattttagtatgcgaattagaaatgaaagagggattgaatatagaaaaaataaagaggaatttaaaaatgcgattttaagtgatccttattttaatgcactacctcttaaatttggttatgcgattacttgtcataaagcacagggtagcgaatggaataatgtcattgtgcaatgtaataacactcatcaaaatcaacatgctttaggttattctcgttggctttatactgcgattactcgtagttcgaaacaactctatttaattgatccgcctaaatttaatgcatgggataaattaaagaaaactactcctacttctatttcgccaattttactacaaccgcagctagaaaaaacggaagagaggcctaaaatgaaaaatgatcaaacaacagcaccattaaaaccggcattcaatgctgccgaattatcagcaatttctcagctcatttatcaaacagtatctactacaattaataatgcggatattattaacattgaaagcaaacaatatcacgatatttatactgtgttacaagatcaacataaaatccgttttaaagttgcttataatggaaaaaatcaaatcacccatattaactgtattgaaaatttacaagtagttccattattggaaagtcagttaaaaacattagaaggaaaaacattttttattgccgcacaagaaaaaaatgaaattacatttagctatgactttctcaatgaatttcatcagcaagtgatctttaattttctaagtaaaaataagataactatttgctcagtagatgaaaaacagtggaacattcgttatgaatttgccaataaatcggaaggaactgcgactttagatatttattttaatggtaaacatgaatttaccaatatcaaaccaatacagcctaaatcaacgtctaacgagtttttagaaactgtacatcgccttttaatgtcggagttgtgtaaatgttaacttttaccagtaaagaagtttttgcagaaagaaaaaatggcaatgccgagcaagcctataaaatggctaaacagctaatggcaaataatccaaatgacgaatggaatcaaagagctttagcttggtgtttagttgatctgataaaacattctactcaacaacatcaagaggcgatacattatattaatgaatttaagctaattgatgttgtaaaaaaagatgaattgttaacgaagcaattaaattactttgagaaataaaatgatccattgaacaatgaaattaacctcgctagagaagctagcaaatcgcgaaaatataaagaagctgccaatatttattttaagatattaaaacaacaaccggataacttagaaattcaaactagcttcgcgtggagtctttattttcttgctaaagaaacattaagccaatcatatataaaaactgaaaacataaaacgttatttttttgaatacttcaaacttaacattgaaaaaacatcaaaattacatcactgttttttatttcttgcattgaaattggttaagaatgaaaaattagccaaagaaaataatatcgatttttccgatttttgtttaaaatggaatttagataatctgaattgggaagattataaaatacaaaaaatagaaggaaatgaattttctccctttgctttagatatatttagaaatgcattaaaaagtgcaataaatcataataatcatcaaagtttagattatttggttcaatttattgagggtaaaaaaagccagcttcaaggggaaactatttggctggagtgggatttggctaaatcttatcattttttgaatcaggatatattagctaaaaataaagcatttgcattattgaaatcgaaacctaatgaatactggctatgggatttcttaggtgatatttatgctgtgtttgataaagaaacctcggctgcttgttatgctaaatccatcactttacaaaaagatattggttttatctataaaataaaattcaaactggtaaattattttattgcaaacggttattttgaagctgcaaaatgcgaaattaaagaaattattgattataaggaggcatagactcaaaaaactccggaagatattttatcattaacggaaagccaatggtatttatccactgaatgtgctactaataatcaaactttctatcaaaaactttccaaggaggcagaagtcttactttatagcaatcttccttggattgatgcatatttaggagatatttttgaaaataatgataagaaaatgtgtaaagtgtttatcaaatttaatgaaatcccaacggagatttcattacctgaaagcaaactatctttaaaatcagcaaaatcagggaaatatgctcaacttaaaggggaatttgagggaggtaaatttaagctttttctctgccgagagattgatgaaatacatcaacatcaaaaagatttctttactcggaaaatagcaattattgataatatcaatcatgagaaaaaagttgtgcatttcttagtgaatgaaaaaattggtacggtcgtttctataaaagaacttaattttaccccaaaagttgctgatgtagttgagattagcttatctcagcatactctcaaagatggagcaaaacgctacaaggtacatcatattgaaaaaatcgaaaaatcagcacctaatgatttactaaaatgctttgatgaacaaattcgggagaataatggcattgcctttacagaagagagcgatatatttattccaagtgatattgttaaaaattttgagttaagtgatggagattgggtttttggtatcgcaataaaaaattacaataaaaagaaaaaggaatggggatggaaagcggttaaaataacatctaaagagctttaagttgattttgatggagatattttattcatagattagatttttccaagacttatttaatcggcaacaaggtcatatatttatcaatatgaatatcggaaattttttaaatccaataattccactttttatgtcgtgcagagaattatcctaaggcgtagtttttcgtctatgtcttgctcgtgttttgttagctactccaaataaaatgaatgtcaatgggctgattatttgaggtatagatggcaaaaatgatgatactactactgaaagagctagactccccacggaattttagtagctcatcatgccaatgttggtagaccttagaatcaggattcgtcaaagcttgatgccaccctacacgttgtgcaatgaactgtcaaagtcctacatcaagtcagaacaggtaacaaatcgccccaactctaatggaacggctccacatggtacttctaaatagactttgatatgattcaacgcataatccaaaaaatcaaattcgggtaatttaaataaagttgccatatactgattcaacagcggttttcgttgaaatagagttgattttgataatattacttacttcatgccccgacaaaaagtcggggtattacgttttaaatcagcaaagttgctgcttttatgacagcttcaatagctttctgttcagtttgatgaatggtttgttcgtttggaatttcttgttgagtacggtttacgattacacctgataccatacctgcacgcagtcccaaagctgaacacattgtaaataatgttgcactttccatttcatagttcatgacattcaatgcttgccattgttttaatgaaccttgataatggcgacaaacttttccgctataggtatcgtaacgttcttgtcctggatagaaggtgtctgatgaggcggtaatgccgatatgaacactatctccaggttcatttgaaacagcatgatgtaaagcggacatgcaatcaaaatgggcaacagcaggatattctagtggagcaaaatgacggcttgcaccatcaagacgtactgctcctgtggtaataagaatatctcctacgttgatgtgcggttgaattgcacccgttgtaccgattctgaggaaagttcggatccccagttgtgctaattcttctaccgcaatagaaacggaaggaccaccaattccagttgagcaaacaacgacggctttttgacctatataacccaaccaagaagtaaattctcgagttgaagctaaaaatttcggattatccaatagacgagcaatacgttctaccctttcaggtgcacctggtacgatggctaactctgctccatccagtgaggcttttgttaagccaagatgaaagacatcagacataaaatattccttttgtttgttgtaatatctctcagtataaagcacctctgcaatttcatcaattctttcctgttggtataaaatatgggaaggtacaatatgagtgttaaggttggactctaatcttctataagattagaatattccttgaaatataattccacctgttggtagaaaaattgattttttcactgctctttttattagtatttatttttaaaatatcggtaaatgagtatatcatagagtatgtttttatatatttttcatattattttggactatggatataaaattacatttaaatgcaactacgacaccaaaaattcgagcttatttacaaaaatcagataaatcagatcttgagttagcagaacagttaggcatttcggttcaaacggtacgtcgttggagaaataggcaagatgttaatgatcgttctcatagaccgaaaaaaattaatagaactctttcttttgaacaggaatatttgatttgctacctacgaaaatatttcgctttatctttagatgaacttcttgaagctggaagaaatctaatcaatcaaagagtatctcgagcagttattagtcgttgtttaaaaaaatatggtctaaatattgctaataagaaagatttaccatctcaagttggttgtacttttttggcaatgtttcccctgcctaaagagatttctaaagaggaagattatctttttattctaatagagaaattgacaggatatatcagttgtgcttgcttggacagaaaactacagcgtcaacaaagtattatcaattactttaaatctagtttaccttatgaaattcaagaaattgagttagccgaagatattactcatcatgccatagtacaggcttttgccaaaaagactaaagtagttacgtctaccttaattttgcaaagtgcggtgaattttgaacaagattttatacggttagtatcaggttattacactgatagcagattaggatttgatgcacaactattaagatatgaagagtatctgaataagcatcttaaacgaaatcgcttaaaaaaactgtccccttatgattatcttatgaaatatcgccggtaggacagttagtttttttatttttttcgatatagctcaataaattctttgatgatgtccattaacaaaacagcattcattacatgatcttgtgcatgcaccataataatagtgacgggtagtttcccctcaccttcatcctgtccgatgagttctgtttgagcgtgatgtgctgctaacaaagcatcatccgcctgtttaagtaatctatctacttcctcaaactgctgttttttagcatgttgtagtgcttccattaaagcactacgacatattcccgcttgaagaattaaattcatcaattgcatttcaagttgctcactcatttttcctccaataaagatagtgcttgtgctaaaattttttctccatcggtcatgccataactcatcatatcaatacaagcgacaggtttgccgaattctgcaccaatagtttggcattcttgcagcttataggaaatttgaggacctaataggacacagtcaaaatcttgtattaatgaacgaaagctttgcatacccttagcttcaatttcaacgggtaaaccctgtgcttcagctgcttgtttcatacgtttaactactaagctggtggacatgcctaaatcacaaataagtaaaattcttttcattttttctccctattttgaaacattatttttcagaaattgataaagtagatgtaatggtttaccgcttgaatagattccttgatctctaaataaggttgtgccgctaatatctaaatgagcccaagtgcagtcattaacaaaccgactaaggaaatatcctgcggaaacacaaatcgccgcattatttggcggagtgttgcaataatctgcaatatggctttccacttggccgagaaatctatcatcacaaggtagttgccatatcgcctcttgtgtttgtattgcggctaaattaagttgatgtagaatttctgtattatttgtcatcacaccggaaatatcataaccaagtgcttttacaacagctcctgttaaagttgcaacatcaataattactgagggtttttgttcagctgcgaatgataataaatcagctaaaattaaccgcccttctgcgtctgtattaataatttcaatagtttttcctgaataagatcggacaatctctccggggcgcatcgctttttcatttatcatattttctgctacaccgacaataatacgtatgttaataggcaatgaattttctacaacggtttcaagtaagccaattaataaggcagcaccacacatatcatatttcatggttttcataccatcgcctgtttttaaccataatcctcctgtatcaaaagtgatacctttaccaacgaaacaataggtctgattacaatcaggggagccttggtaatcgacttgaattaaaaaagggggatgtaaaccgcttttacctacggcatataaagtgttcaaaccatggttttgtagctcttctgcatctaagcatcgtatggaaagttgagatttatgtgcataactgtttaatttttttgcaatatattcaggcgtcgcaatatcgctaggcagatctgaaatttttctagctgttatcatacccaatactattttgcatagttctaaataattattcgatagttgccgcttttgctccggtgtttccactataacaccaaattcaggcgatgcggcggtctctttaaaacctaaatattttggatggtaagaaaggttgagataactaataatcaattgttcattgatctgccgttctaattttacggtttcttttctccaatgtaataagattctttgtgcatctgagtgtgctattttttccatcaaaaaatgacgtattttccccattaagtgtgggttttcagccacttcttttttagaaaaaggtaagctatataagccggcattcgatatatttctgcctatctcgattttgctttccatgtccagtatagaaagcagaggtttcaagcagggttgttgctgtaaaaaatctcgatcttctttccaaaaaaacaacaaagcgttttttatctctaattgggtttgccaatcataaagcggaaattcaatgttcattttaactctccatgaatgcggtcaagataagcttgtagccaactttctgaggccggttcatattgtgtaattccattttctcgtttagccagataaatgatagggttatattgctctgttgatacgacaaaggaaaaattatcaatattagttgatacaccgaactctccttgcatattcatacatacaaccgacaaatctcctgctgttccgtaacgttctaataatcgtatttctaattcattgattgtcgtatcagcagcttgttgtggtgtcatcccctctttcatttttcgtacaatttcataactggtgcagcctttcattaagtcttcccccagacctgtagctgttgccgcacctatatgggaatcagcatagaatcctgaacctgagataggcgaatctccaactcgcccatgacgtttcataaataacccactggtagaggtacccacacaaatattattatttttatcaagtgcaataatgcccactgtatcatgcccggaatatggacttaatccacgaccgagagtctcttgatagcgtttttcataaaatgttttaacacggggcgttagcatatctttagcaggaaagcctttctttaatgcccatttttcagcaccgtgacctaccaaaaaactattaaaacgttcatgacttaatgcttcggcaacgagaattggattagcgatattacgcaagccggctacagctcccaatgccagagaagttccatccataaaggcagcgtccaattcgacatctccctcttcattgggtaacccgccataaccaacagatttatatagagggtaattttctacttgtgtaaccgcagttaaaattgcatctcttgcacttcctttgtttttaagtaattcaactgcctgacaaagtccttcaaatgccatacgccaagttgcaatcatcccccatcttgaattattcatttatacttgtccttctttcattcgatattgcttatcaataatacggaagaatggtaaataaatcattgcagcaatgaataagttgattacttgtataagtgcgccggaaatatgcccagttacaataaaaccacttaaaacaggcggtaatgtccaagggatataaactccggttgtcgtcgcaacaatatctaaatacattgcaacatactgtactgtagtaataactaaaggtgcaagattgaatgggataagcataattggatttaaaataacgggcagaccaaataagacaggttcgttgatgttaaataccgatgagccggcagctaaacgtgacacttttttagcatgttggctacgggcaaaaataagcattgctaagactaaggcgagagttgaacctgaacctcccataaagatcatatcaaagaattgttcggtaatcacatgaggaggggttaatccattttgcattgctgccaggttttcagcttgattatctaaccagaacggtcgtaagattccattaaccattgaacctgaattgattcctaccgaccataaaatatcgatcatgaatacggtcagtaatgcaccaatataagaagtaccaaaatggcgaattggtgtagccagcacggtatatacaaattcatgaatagtattatattcagttttcgagaataaaatccgaatgcctaatactaaaatcataatcaataaggcaggtatcagagctgagaatgattgttgtactgccggcggtacgccgtcaggcattttgatcacaatatttttgcgaatgagaaaggcgaataattcggtccaaatgattgccccaagcatagcaataaataaaccttttgaacctagccattgcgttgaaataactgaaccgacgttttcaactttaacaaaaggggtcaaaataaggaatgctgagagagataatataccggaggaaagtttatctatatttagacgttcaccgagtctataggcaaccagaaaagcaataaatatagacattgtagaaaaaacagcattaaagggaatttctatgatattatcccaaccctttccaaaggttgcggtcatgaaatctttatagctttgagatggaaatgaactaattaccagtaaaatagaaccaacaatgataaaaggcataaacgaaatataagcatctcgaattgctcctaaatgacgctgttgggctaatttaccggcagccaccatcaatttattttcaatttgtttaaacaaggacataataacctccagtaagtaagaaattacaaaacttattgtaggtgatttttgtttgaaaaaagttgataaagatcacaaaattaaaaaagtatcatatgattaattttattttaatgtaaatattattagaatatatttaattttttaaatgtttaatgatgtgatacatttttttaggtttgtatggatatagaaatatgtattgataatattgagtcagcattaattgcacaaaattcaggtgcggatcgtttagaagtatgtggatgtttagcgttaggaggggtaactcctccttatagcctgatcaaaacagtattggatgtgtgtaacattccctgttatgtaatgattcgtcctagatccggagattttttatttaatgcacatgaaataaaaatgatggagcaggacatccacattgcgaaacagttaggagctcaaggtgttgttattggagcattaaccgaaaacggtgaaattgatttatcaatttgccatcgtctaataagtgcggctgaaggtttgggggttacttttcatcgtgcgtttgatctttgtagcgatccttatcatggtttagaacagcttattgaattggggtgtgagcgagttttaacttcaggacagcaaaggacggcatttgaggggagatatgttttaaagaccttggtacaacaggcaaaaggacgaattaagattatggctggtgccggcgttaatccaaataatgccttggaattggtaaaaatcagtaaagttgatgaattacatttatcagccaaaacttttcgtcagagttcaatgaaaggtaattccagtgtgacgatgggaaataaagcagaagatgattacaaaatttggacaacagatcgaaatcaaattattgccataaagaaacttttccaagaatagaggggcataaattttatctggagagcggtgaaaaaaacaaaattttcaccgctcttttttcattattcaaccaactaattttgccgtgaaaatattactaataaccacaacatttttagagaaataaggtagaatacgcccctatttatttttataaagagctttgttttatttatgttatttgcaattggtcagcgttggataagtgaaagtgagaatagtcttggtttgggtattattacgggacaagataatcgtaccgttaccatttcttttcccgcctcggatgaaatgcgtatttatgctttagcaagtgcccctttaactcgagtattgtttcaaaaaggtgatgagattacacaccaattaggttggaaagcaaaagttgttgatgtcatgattcgcaatgagttggctttttatcttgtgcaacgacttgataataacgaagagattgctgtacaagaaatggaattagctcaccaaatttcttttagtaaaccgcaggatcgcttatttagtacacaaattgaccgcaatgagcattttgtattgcgttacaaggcactaaaacaccaacaagaacaatttcagtcctctttaagaggattaagaggaaatcgagccggtctgattcctcatcaattacatattgcacaagaggtagggcgacgtatcgcaccaagggtattattagccgatgaagtcggtttggggaaaacgattgaagcgggtatgattttacagcaacaattgcttgctgaaaaagttcagcgagtgctaattttggtgcctgaaactttacagcatcagtggcttgttgaaatgcttcgtcgttttaatttgcatttctctttatttgatgaagaacggtgtgctgattttgataatccggaagatcatgttgaagcaaatccttttgttgctgaaaacctaattatttgtgctttagattggcttgttcaacaaccgaaacgtgcaaaacaagccttggcgggtgagtttgatttattgattgttgatgaggctcatcatctcacttggtcggaagattcgccaagcatagcttatgaattggttatgcaattaagtgcggtgattcctgccgtattattattaacggcgacaccagagcaattggggcaacaaagtcattttgcccgtttgcatttattggatcctaatcgtttttatagttatcgggcttttgaaaaagaacagcaacaatatcaacctgttgctaaagcagtacaaagtctgttatcagagcatattttaacagttgaagaacaaaatcatttagcagaattacttagcgagcaagatatcgagccaatgctcaaagtgattaattctcaagctgatacggaacaaaagcaggttgctcgaggagaattaatgagtaatctaattgatcgtcatggaaccggtcgcttgttatttcgcaatacaagacaaggtgtgcaagggtttcctcatcgtatttatcatcaaatcaaattagatttaccaacacaatatcaaaatgcgattaatgtgttgaagatgttgggggaaataaaagatcctgagttattttatcctgagcaaattttccaaaaaatgaatgcggatgcaacttggtggcgttttgatcctagagtggattggttaattcatttagttaagagtttacgtgaagaaaaaatcttagtgatttgtcaagatgcgataacagccatacaattggagcaggcattgcgagagaaggaaggaattcgtagtgcggtatttcatgagaatatgtcgattattgaacgagatcgtgcctctgcatattttgcacagcaagaagagggtgcacaggtattactaagttcttcaatcggttcggaaggtcgaaattttcagtttgcttgtcatttagtgttattccatttgccgaataatcccgatttattggaacaatgtattgggcggttggatcgtataggtcaacgtcgagatattcaaatttatgtcccttgttttgctgatacaccgcaaattcgcttggctcaatggtaccatgaagggttgaatgcatttgaggaaacctgtccaatgggggctattttgcatgaaaagtgcggtgcaaaattgacagaatttttaacttcagacacaacggacgattttcagtcttttattcaacagactcatcagcaacaattacagctaaaatccgaattggagcaaggtcgagatcgtttattggaacttaattccaatggcggtatccaagcccaacaattagcaaatgacatcgcgatacaagacggttcaacagagctcattgatttcacattgaacttattcgatattattggtgttgagcaagaagatcttggcgaaaaatctattgtcattagcccgacaggaacgatgcttgtccctgattttccgggtttaaaagaagaaggggttactgttacttttgatcgtgatttagcgttggctcgtgaagatcttgagtttcttacttgggatcacccaattgtgcgtaatgggattgatttaatcgtcagtggtgatataggtaaaagtgcggtagctttattggtaaataaacaattacctaccggtacattgctacttgaattagtttatataattgagagccaatcaccacgtggattacagttgactcgctttttacctccaacaccgctacgtttacttcttgatattaaagggaatgatttaagtcatcaaatttcttttcagggcttgcaaaaacaactgaaaccaatgggtaaaaatatggcaacaaaagtcattaaaataatgcgtccagcgattgagcaattaattaagcaaagtgcaaaaaatgtagttgagccagctaaaatgataattgaacaagctaaacaactggcggatcaatcattgagtgcggaaataaatcgattatatgcgttgcaggcggtcaataaaaatattcgtccggaggaaattgaacagttagaaagtcagcgtacgttatctcttgaattgcttaatcaagcaaattggcgtttagacagtttacgggtaattgtgagtaataaggaataacatggcattaattgattatcgtccccctttagaaccttatttggacattgtatatcgtgatgatcatattctcgtggtgaataaaccgagcggcttgctttctgtatccggtaatcaaccgcaatattatgatagtgcaatgtcgagggtgaaagaaaaatatgggttttgtgagccggcacatcgtctagatatggcaacaagcggcgttttgctttttgcaatgagtaaaatggcagatcgagagctaaaacgccaatttcgtgagcgtgaacctaaaaaacattatcaagcactgatttggggacatttagcacaagataccggcacggtgaatttgccgttggtttgtgattgggaaaatcgcccaagacaaaaaatttgttttgttcatggaaaaagtgcggtaacaaattttgaggttttacaaagattcaaaaataatatcactcaagtcagattaacgcctattaccggaagatcacatcaattacgcttacatatgcttgcattaggacatccaattttaggcgataaattctatgcacccccacaagcaaaatcgcttgctccacgtttgtgtttgcatgcggaatttttacaaataactcacccgctgacaaaagaagtgatgcaatttagcacaccggcggattttccgatttgagttgctagcataaataatcagcccttaatctatatgattacgggctgtgtgtttataaggaactattgtctatttttataatactcaatagcttgtggcattaattttaataaattcgcttggcgagcatcatcggtggggtgagttgagatgagcttatccagcaaaccttttgaacccccggaggcttttttcattttttcccacaattgtggtgctgctttaggattgtagcctgattttgccatcaggaataagcctacttcatccgcctcttcttcggcactacgtgaataaggtttatttaagccccaatccgcagcaagtccgacaatcagtccacttgcgtcagtgccaatttttgttgataaagcaacatgagcaacctgtgcaaccacattagtgaacgtacccaaattcgcttttttcttaccatgttcttttaacgcatgtgccatttcatgccccattactgtagcaatttcatcatcagttaattttaagttgtcaactaatcccgtataaaacaccattttgcctcccggcatcgcccaagcattcatttcttttgatttgataacatttaattgccatgtaaaaacttgcccggtgttgttttctttatctgcataaggatgcatttttttaaaaattttatgtatacgttttgccgtcggtgagcttttatcaaccactccttttgcttcagcttgcccgattatctgcacataacttgaggcagactgttgattaattgaagatgaatctgcacaagcattgagcagtaacacagtaaatatgacaaaaataatttttttaatcgacataatgatatttaaactgttaataaaaaaccgccctttgagtaagagcggtttttagagattattttttagcacgttcgaatgattctaaaatttcttggcgagctgcttcaacgccttcccaaccttctactttaacccatttacctgcttccaatgctttatagctttcaaagaagtgctggatttgtgcttttaataaagccggtagatcatcaacatctttaatatgatcatattctttacttaattttgtgtgtggaacagctacaacttttgcatctccaccggcttcatctgtcatttttaatacaccaactggacgacaacggattacagaacccggttgtaacggatatggcgttggtactaatacatccacaggatcaccatcagaagaaagagtattatttacataaccatagttcgcaggatagaacatagcggtcgccataaaacgatcgacaaataatgccccactttctttatctacttcgtacttgattggatctgagtttgccggaatttcaatgacaacataaatatcatccggtaacgctttaccggcaggtacattttctaaacccatttttcttttccttttacatgttattgatgaatcaggttggggaattatagcgttatttctagggaattgtcgagttatcaacaaagaatcttcttactgaaaaaagtattgtaaaaaagttttgaactattataatagttcaaaatttaattttcaaaatgaggatctattatgacaaaaaaaatcccttctttatttggtggtgcaatgattattgccggaggaactatcggggcaggaatgttagccaatcctacttcaactgcgggtgtatggtttttaggttcaacattaatcttaatttatacttggttttgtatgacaacatcaggattgatgttacttgaggcaaatctacattatcctacgggtgccagttttgatactattgtcaaagatttattagggaaaggttggaatttgattaatggtgtgtctgtcgcatttgtgctttatattttaacctatgcttatatcacttcaggcggtgggattacgcaaggtttttttaatcaattgttaagtagtacagaaaatgcggtagatattgggcgtagttccggatcgcttatcttttgtattgtgctggcagggtttgtatggttttccactaaagctgttgatcgtttcagtgtggtattaattgcaggaatggtcatttcctttttcctctctataaccaatcttgtcggttcggtaaatacagaagtattgctaaatgctgtacaaggtgaacaacaatatttgccttatgcgttggtggcgttacctgtttgtttggtttcttttggctttcatcaaaatgttcccagtttggtgaaatattatgatcgcaatgcaagtcaggttttaaaagcgattttcataggtacaggcattgcattagtgatttatatcttgtggcagttggctattcagggaaatttaccaagagctgaatttataccagtcattgaaaagggcggtgatatttcagcattattagacgcattaagtaaatacttacaaacggattatatagcacttacactgaaattttttgcttatatggcaattgcaagttcattcttaggtgtaacgttagggttatttgattatatcgctgatttatttaaatttgatgatagtgttgctggacgcactaaaacagcgttaattacgtttttaccgccattattattgagcttacaatttccttacggctttgtattagccattggttatgctggtttagcagcaacaatttgggcggtaattgtaccggctttattagcgaaagctagtcgtaagaaattcaaaagtagcagttttaccgcttacggtggaaattttatgatatatttcgtcatcgcatttggtttattaaatatcttcgcacaacttgcaatgcagttcggttttttaccggagtttagaggctaaatagcttgaaaaagtaagaaaaataattatcttgttgacgtatgctttatttggcacccactgtagatacgtgggtgcttttctgtaaattttcctagtattagctttgatttgtttgctatagtaggcacaatttttagggagtattgtaggataaaaatggcagaaaaaatcattattgctgaacatcagtttatgcgtacgatttctcgtatttcccatgagattatcgaaaaacatcagtcgcttgatgatattgtgattgttggcattaaacgtcgaggtgctgaacttgctgagttaataaagcgaaaaattatagagttcagtggaattgaattgccctctattgatttagatatcacttcttaccgtgatgatttagagtatgtggatcaacagcaccagttgcctgtttatagtggagcatccaattatattaatatccagaataaaacggtgattttagttgatgatgtattgtttactggtcgtaccattcgagccgcacttgatgctttagttgattttggtcgagcggctaaagtggaattagtgatttttgtcgatcgtgggcatagagaattaccaattcgtgccgattacgtcgggaaaaatattcccacaagtcgtagtgagcaagttcaggttcgcacaatgcaatttgatgatcgttatgaagttgccttggtcacaaaataacatttgtgaaccttttgcaaaattgctactctaatgaacaaatttacaaacgtcttacggaatgaaaaagcggaataaaaaaatgaaagtatttaatttcaaagcagtgttgttttcaataattggtctacttagcattacgataacagcacaggcggctgaaagggtagtggctaccgttgatgggaatcctattttagaaagccaagtaaaaaaggtgttgggaaaacgagcaaataatgaggaaaatcgtcaaatagctttgaatagtattattgatgatttactagtacaaaaagctattcaagagttaggaatcaaggttgctccagcacatgtagatagtgttatcgaaaatattgccgcacaaaatggattaacctttggacagtttcttgatgttttagattatcagggcattaattatcaggcgtatcgtcaacagattgcctatcagattttaatatctgaagtgcgtaatcaagctattggcagtagcgtgaatgttactcgtgaagaaattcaagacttaggactaaaactatttaaacaagcgaaaaaacaaggaaaagagaaaaaagtaaccgcacctgaatataatgtacggcatattttgttaaaattgaatcctctgctgaatgatgcacaagccaaagcaaaattaactcaaattcgtgcagatattttggcgaataagataacctttgcggatgccgccttgaaatattctaaagattatctttccggtgcagatggtggaagtttaggttttatgttccctgaagcctatgttccagagtttgccaaggttatccgaacatctaaaaaaggtgtgatttcgacaccattcaaaacagagtttggttggcatattttagaagtaacggatattcgcaatgcggatataacgagagaagcttatatgcaagaagcatatcaacaaattgtgaatcaacaattgcaagaggcatcaggcgactggataaaggctttgcgtaaacgagcacatattcaatattttaattaattatgagatcccgacgcaaagtcgggatttttgttttataataccgccaattttttagcattcacactttcacttatgaagtcaaaaacacatttaggacatactgctcgtaaacgttttgggcaaaatttcttgcatgacaataatattattcaaaatattgtgatggcaatttatccacaaaaagaacaatttcttgttgagattggtcccggtttaggtgcgttgactgaaccggttgccgaaaaagtagagcgtttaacggttattgagttggatcgtgatcttgctgaacgtttacgccatcatccatttttacatcaaaaattaaatgtgattgaatatgatgcaatgcaatttaattttgaacagctttatattgatgaaaacttggctgagaaaaatcagaagttacgtgtatttggtaacttaccttacaatatttcaacacctttgatgtttcatcttttcaaatatcatgcaattattcaagatatgcactttatgctacaaaaagaggtcgttaaacgtctttgtgcagcaccaaacagtaaagcttatggtcgtttaactatcatggcacaatatttttgccaagtattaccggttttagaagttcctccgaccgcatttaaacctgcacctaaagtcgaatcggctgttgtgcgtttaataccacataaagaattaccttatccggtgaaagatttgtactggttaaatcgtctgactacacaagcctttaaccagcgtcgtaaaactttacgtaatgctttatcaaccttattttcggcggaaaaattaaccgcacttgcaattgatttagaggcacgagccgaaaatttatctattgctgattatgcaagattggcaaattatttagcggataatccgccaacagaagatctgcaatcggagtaaaaatccaagacaaaactgcaagagttaagataataatcaatgacaacattatggcaacttatttagtcggtgatttacaaggctgttatgacgaattacagcttttgttagagacggttcaatttaatcctgtacaagataaactttatcttgttggtgacttagtagcacgaggcgataaatccttagaatgtttgcgttttgtaaaatctttaggggcggcggcacaaatggtattgggcaatcacgatttgcatctgatttcaaccgcacttggtattaaaaaagtaagtttacaagaccatgtcgaagcgatttttacagcaccggattttgttgaattaattgattggttgcgacatcagcctttgcttgtccatgatgaaaaatgtgattttgtcatgagtcatgcgggcatttcgcctgactgggatttggataccgcaaaatcttgtgcaagagaagttgaaaatgaattacaacatggtgattaccattatttaatcagcaatatgtatgataaccaacctgatcgttggtctgccgatctgcaaggtttgcaacgtttacgttatagtatcaatgtatttactcgaatgcgtttttgctacagggatcatcgcttagatttcgcttgtaaagcgtcagtagaaaaagcaccgcaggaacttatcccttggtttaacttggataatccgttgtttaaagtacaaaatttggttttcggacattgggcaagtttagtggatacaccgacaccggcaaatatttatgcccttgatacaggttgtgtttggggtaaccgtatgacgatgttacggtgggaagataaacagtattttgttcaaggagcattgaaagattatttttagagtggcaacagtgcaatattatgtcgtgtgcaataatctgaataacagagaactgtagtgcggtgcggttcatataacaatatatgctaagtgtgcggttgtattgtgagtaacgatttttccttgtcgccgctcaagaatttccctgttcatttctccggttttaggctatcctatagcacattttctatatccaatttgcaccgcactttccattatgaataagtcttttagtaaggggtttagcggaaaaagtgcggtaatttttcatataaaaggtaatattatgcaagaacaatatcgtcctgatcttatcgaagcagacgtacagaaatattgggctgaaaagaaaacattcaaagccgttaaagatccttccaaagaaaaatattattgtctttccatgtttccttatccttccggtcgtttacacatggggcatgttcgtaactataccattggcgatgttatctcccgttatcaacgaatgaacggtaaaaatgttttacagcctatgggctgggatgcttttgggttgccagcagaaggtgcggcaattaaaaataaaaccgcaccggcaaaatggacttatgaaaatatcgaatacatgaaaaatcagcttaaagtgttgggcttcggatttgactgggatcgtgaaattaccacttgtaaacctgaatattataaatgggagcaatggttttttactgagttgtacaaaaaaggattggtttataaaaaaacctcaacagtaaactggtgtccgaatgatgaaaccgttttggcaaatgagcaagtacatgaggggtgttgttggcgttgcgatacccctgtggagcaaaaagaaattccgcaatggtttattaaaattacggactatgctgaacaattattaagtgatttagatcagcttcctgaatggccggatatggtaaaaactatgcaacgtaactggataggtcgctccgaaggggttgaaattacctttaacgttgctcattcagatcaaaccttaacagtttatacaacccgcccggatactttctatggtgtttcttatttagcggttgcggcggcacatccgttagctgaaagtgcggcaaaaaataatcctgaattggctgcttttattcacgaggcaaaaaataccaaagtggctgaagcggaacttgccacaatggagaaaaaaggcatggcaacaggattgtatgccgttcatccgatgacaggtaaacagttaccgatttgggtagcaaattttgtgttaatgcactacggtacaggtgcggttatggcagttcctgcacatgatcaacgtgattatgaatttgcacaaaaatatcaattgcctttattccccgtgattaagccggcggataattctgcatgggatttttcaaaacaggcttatactgagcatggtatcaccattaattctgctgagtttgacggtttggattttgaggaaacctttaacggtattgcggataaacttgaaaaaatcggtgtaggaaaacgccaagtaaactatcgtttacgtgactggggagtttcccgtcaacgttattggggagcaccaattccaatgctgacactggaaaatggtgatgttgtagttgccccattacaggacttaccaattgttttgccggaagatgtagtcatggacggagtaaaaagtccgattaaggcagatcctgaatgggcaaaaaccacttataacggacaagtagcattaaaagaaacggatacctttgatactttcatggaatcttcttggtactatgcacgctatacctctccacaatatcaacaagcgatgttagatgcagatgaagcgaattattggctaccggtggatcaatatattggtggcattgaacatgcaaccatgcacctattatatttccgtttctttcataaattgttgcgagatgccggtttcgtaacttctgatgagccaagcaaaaaattactgtgtcaaggtatggtacttgcagacgcattttattacaccagcccaaccaatgagcgtatttgggtatcgccgacaaaagtaacgttagagcgtgatgagaaggggcgtattatcaaagctgttgatgatgaaggtcacgagcttgttcacagcggtatgaccaaaatgtctaagtccaaaaataatggtattgatccgcaagaaatggtggagaaatacggtgcagatacagtccgtttatttatgatgtttgcttcaccggcagaaatgacactcgaatggcaagagtcaggagtagagggggcaaatcgtttcttacgccgcctatggaatttagtttttgaatacaatcaaaatccggcacaaaccgcattagatcctaccgctctttcagtcgaacaaaaagcattgcgtcgtgatgtacataaaactattgcaaaagtgagcgatgatattggtcgtcgccaaacattcaataccgcaattgcggcaatcatggaattaatgaataaactcaccaaagcatcattatccaatgagcaagatcgtgcagtaatggcagaagcattgaatgccgttgtgcgtatgctttatccgattacaccacatatttgtttccaactttggcaagacttaggtaacgaaagtgcgattgattttgcaccttgggtgatagccgatgctgaagctatggttgaagatgaaaaattggttgtgatacaagtgaatggtaaagttcgtgctaaagtaaccgttcctgctgatatgtcggaagatgaaattaaacaagttgctttagcagaagaaaatgtacaaaaattcttgaatggtttaactgtagttaagaccatttatgtaccgggtaaattatttagctttgtagcaaaataagaaaacataaccgcacgtgaaagtgcggttcaatttaggggagtttttatgttcaaaaaaattaaaatagcattactgggcattggcattttgcttattagtgcttgtgggtttcattttcaaaatggtgaactaattccaaatgaattaagaacattggtactggaaagcaacgaccctcacagtaatatgtcaattgccctacgtcgtcaattacaagctaacaatgtgagtatcgttgataatcaaaataatgtcactgttttgcgtctaaatagcacaaaaaatactgagcaggtagcctcagttttcaagcgaggttatgaagcagagaaaattttaacattagaagtatgggcaacagtgagtttaccgaataaacaaagctatctgatttttgctaatgtcaaccgcactttctttgataactctcgtgccgcattagcaaaatcagcagagaaggagattatttggaatgatatgcgtgaacaggcagcccgccaattaattggcaaaatgattgcattacaaacgcaacttcaaggtaaataatgaaccgcatcttttccgaacagctccaattatcactcaataaacggttgtccactgtgtattatttggttggacaagatcctttattgctgactgagagccgagatgcaattgtacagactgcgatattacaagggtttgatgaaaagttagaaattactgtagatcataccactaactggcgttctattttggaacaggctcaatctatggggttattctttaagcgtcaaatgctgattttaactttacctgaaaatccgaccgcacttatacagcggaatttacaagaactgataacgttacttcataccgatatcttactgattttacagatggcgaaacttactaagccaatggaaaaacaaacgtggtttgaattagcaggacaaaaagagcctcaagctgtgttagtgaattgccaaacaccgactgtcgaccaattgcctcgttggatcagtcagcgtgcatacagtatgaaattagagattgtgccggaggcgataaatctgctttgttatagctatgagaacaatttacttgctttaaagcaggttttacaattgctcgatttgctttatccggatcataaattgacctttaatcgagtgaattcggtcatagagcaatcttccgtatttactgtatttcaatggattgatacgttgttagagggaaaattagagcgggcagtgcgaattttacaagggttaaaagcagaagatgtacaaccgataattttgttacgtgctttacaacgagagctactcacgattttacaattgacccaaccacaacagcatatcgctaatattgacattccgctggtgaattcacaattaaaagaacggtttgatcgcttaaaagtatggcaaaatcgacgtcctttttttatccaagcgatacaacgtatgacttaccgaaagttgtatatgataattcagcaacttgctgatttagaaagaaaaaccaaggcggattttagtcatgatatttggaatgaattagataatttatctgcaaaaatttgctgtttttagttgaattcacaaagaatttaggtttattccatatctctactaacgatttttcttggattcatcattttttgtacaaaatatccgttataattcgtcaattaaaaaagttaatacataggaagaaaaatgatacgttttgaaaatgtgagtaaagcctatttgggcggtaatcctgctttgcaaggactcaattttcatttacctatagggagcatgacttacgttgtggggcattccggtgcagggaaaagtaccctattaaagttaattatgggcatggaacgagcaaatggcggtaaaatttggttcaatgggcataatattacacgtttatctaaatatgaaattccttttctacgccgtcaaattggcatggttcatcaggattatcgtttaatcacggagcataccattgctgaaaatgttgcacttcctttaattattagtggtattcatcctaaagaggctgaaactcgagcattggctgctttagatcgtgttggtttgcgtgagcgtgcgaaacattaccctgtttatttatcgggtggtgaacagcaacgagtggatattgctcgtgctattgtgcataaacctcaattattattagccgatgaaccgacgggaaatttagatatcaaattatcgttgggtatttttaatttatttgaagaacttaatcaattaggcatgacggtgttaattgctactcatgatttaacacttgtccagcagaaaccgaagccttgtttggttttggaaaatggttatttacgttaaggaaaggttatggctcatcgtcctatttatgcctcttggggcgtgcaggtacattatgtactgaaagcagtgttggcagggttaatcaagaaaaagtattcaactttaatgactattttagttattgcggtttcgttaaccattccaaccgttagctatttgttgtggaaaaatttatatcatgcaacgacaaaattttctcctaaaactgaattcacgctatttttgcataaaaatctatcggaaacagatgccaatattgttgtagagaaaatacgccagcaagagggcgtagaaagtttaaattatatttctcgaaaggaaagtttaaacgaatttcgtcatttttccggcttttctgaaggattggatattctggatgataacccgcttcctgctgttgtaatgattaaacttactcaagaatacaatgaaaatactaaacgccatcaactgcgtgaaaatctttttaagattaagggagtggatgatatacgtttagataatgaatggttagaaaaattgaccgcactttcttggctaatcgcacatattgcgatattttgtgccgtattgatggtatgttcagtatttttagtaattggaaatagtatccgatctgatgtatatagcagccaagcgaatattgaaattatgaaattactaggtgcaacagatcagtttattttacgtccttatctttacaccggcatgatttatgcaatattaggtgcgttatttgccagtatatttagtgccgcactcattggttattttacaagtgcggtcaactatgtcactgatatttttgcagtcagttttacgttgcaaggaattactatcattgagttattgtttttatttgtttgctgtacattaatgggctatttaagtgcttggctctcagcaagtcgttatatgaatttgttacataaaaatattagataaaaagcagaaaatttaaaattcttcgcttttttattaaaaaaacttgattttatcttaaatgttctgtaattaattgagatattctttttacaattcaacacaacattaactaataagggagattatatgaaaaatgtaggttttatcggttggcgtggtatggttggctctgtactcatggatcgcatggtacaagaaaatgactttacgaatattaatccagtattttttaccacttctcaggtaggacaaaaagcccctgtttttgcaggtacagatgcaggtgaattaaaaaatgcgtttgatattgcagagttacaaaaactcgacattatcgtcacttgtcaaggcggtgattataccaatgaagtttatccgaaattaaaagcaacaggttggaatggctattgggttgatgcggcatcggcattacgtatgaaagatgatgcgattattgtattagatccggtaaaccaacatgtgattagtgaaggcttacagaaagggatcaaaacctttgttggaggaaattgtactgttagcttaatgttgatggcaattggggggctgtttgaacgtgatttagtggaatgggtttctgttgcaacttatcaggctgcttccggagcaggtgcaaagaatatgcacgagttattagtacaaatgggacagctggaagatagtgtcaaggacgaattggcaaatcctgccacatcaattcttgatattgaacgtaaagttactgcaaaaatgcgtgcagaggacttctcaacaaccaattttggtgcagcattagcaggcagcttaattccttggattgataaattattaccggagacaggacaaactaaagaagaatggaaaggctatgcagaaaccaacaaaatcttaggactaagtaataatccaattccagttgacggtttatgtgtacgtatcggtgcattacgttgccacagtcaagctttcacgatcaaactgaaaaaagatttacctttagatgaaattgaacagattattgcaagtcacaatgaatgggtaaaagttatccctaatgataaagaagtaaccttgcgtgaattaacgccggcgaaagtaacaggcacattaagtattcctgtaggacgattacgcaaattagcaatgggacctgaatacttagcggcatttacagttggagatcaattattatggggggcagctgaaccggttcgccgtattttgaaacagctagtgctttaaatttaagagtgtagttaaatttattactcaagttgacactcgttattgtttgttatctgaattaaatacagtgataataaaataaataaagccctaattggggcttttttatattttaattattaatttgaacgcacttacatcaatgctttggtaggatttttttgctagaaataaaaaactattttttcatcaacaaatcacaactttttcttcatctgcatttgcatgttcgattttaccgattacccatgctttttcgcctacttgttgtaataatgccaatgcagtttccacatcttcctgtgggagagcgataatcatgcctacgccacagttaaaggttctatacatttcatagcgatcaatatttccttgttcttgtaaccatttgaaaataggatgccattcccaactcttttcattaattaccgctttaacggaagacggtaaaacacgcggaatattttcccaaaaaccgccgcctgttaaatggcaaatagcatgaacgtcagtatgtttaattaattgcaacaccggttttacataaatttttgtcggtgcaaggacttgttcagcgaatgaatgctcggctaattgtgctgttgtcggattaatacctgaaacttcaatgactttgcgaattaatgaatatccatttgaatgaggaccgcttgaagctaaggcaagtaatacatcgcctgctttaacgttggaaccgtcaataatttccgatttctcaactacacccacacaaaaacctgccaaatcataatcaccggtatgatacattcccggcatttctgcggtttcaccccctactaaagcacaaccggcttgcacacaaccatcagcaatacctttgatgacatctgctgcaacgtctacatccaatttacctgttgcataatagtcgagaaaaaataacggttctgcaccttgcaccacaagatcattgacacacattgcgaccaaatcaacaccaattgtgtcatgtttttttaggtcaatcgcaaggcgtaacttagtcccaacaccatcagttccggatacaagaataggatccttatatttacttggcaatgcacatagtgcaccgaagccccctaacccaccaataacctcgggtctagttgtacgttttacatcagatttaatacgttctactaatgtattccccgcattaatatccacacctgcgtctttataacttaatgattgtttactcacaattgaatcctaaaattagtatcgttattaaaataagcgatattgtaacacgctcaggcaatcgttttcgatgaattttgtaaagaaattttatcttttattcagcaaaagcgtgttgaaaaataaccgcacttttcctcgtctaaaaacgcagaaatgattatctaacgaattttcctgaaaatgatttaatccattagaaaatcatgcaaaatatctgcggtaaattctttccgcaaataaaatcctaaaggcaaagtatcgattatttcgccatttttaccgattcctttggttaacgctcgactatttgcccctttgggacggagttgcaggacctcaccaatacgggctgtaatttctgtgagcttacccagcacaatataatccatcaattcttcccaatcttgacgcagacgttgttcttgagaacttgatggctgccacaaaattggtacaccgacatggcgttcagcaagcggaatttgacgttcaccctcaataggaatccaaagcactttggataatttatatctgacatgagaagagtgccacgttacaccgctattttgggctaaaggtgccaaacttacaaaagtggtttccagaggataaccttgttgattaacaggaattgtttttagctcaatacctaaatggctaaaatcttgttccgctttgcttccggcagttgcacccagtgcggtttcaataagcattccgacccagcctttatctcgcttcaaatcgggaggcacaaccaaatttaactcttctgctaattcagcaaaggttaaacctgcaatagattttgcacgttgtaacagttcagcttcgtgttgagggggagtaagtgcggtcatgattgatgatatttttgtaataactttggtttcacgtattcaatgcctcgatcaatataatcaattttttccaattgcaataaatagcgttttgccggcaagcctccgccaaaaccggtaagttgcttttgttttcctaaaatacgatggcaaggaataataatgctaatcggattacgtcctacggcaccgcccactgctcttacggctttcggatgatcaatgaaacgtgccaattctccgtaactggcggaatgcccatatggaatttggcgtaaagcctgccatattttttgttgaaattccgtgccttgcggatgtaaaggaagatcggaaaaatcttccgcttccccgttaaaataacgatctaatgccgatgttacctgcaaaaagagcggtagattttgattaaaaatccaacgggaatttggctcaatttgttctaattcaaaatcaagatttgtcagctgattattttgcgacaacatcagcaatcgtccaattggcgaatgataataacaataaaaagtaggttgcataaaagaaaaaaggcgtattaacaaaatacgcctgattataacgaatagccgttagaaacggtagctaagatttaaaccgtacaaattggcacgtgctgttgattgatagtccgcacttactacggctaactgtacatttgtaacctgacctctattacccggataagatacagtatttccaatttcatatccctctttaaattgctgttttttaccacgtaaatgagcaaaacctacatcaacagaaagattaggcgtaaagttataggttgcacccaagctataccaagtgcggtcggtatcggggattgaagcactcggatggtcggcagactcatcataagcaatacctgcacgcagggttaatttatcattcacattataagtcgcccctagagctacacgagaactgtcatcaaagttttcatctttatgaaaagcgacctgaccgttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgacacgatatgaaccgcttaaatttaaattaatggaattcagctcagtagtcccgccaaaaacaccggcatcataatcctttttatatttgctttgtaatccaaagttgacattcatacccgcaccgatagcaaatttgtcattaataggtgccacaaaatacaaattgggaactaatgcaccgggaacaannnnnnnnnnnnnnnnnnnnnnnnnnnnnnnnnnnnnnnnnnnnnnnnnnnnnnnnnnnnnnnnnnnnnnnnnnnnnnnnnnnnnaccatttatattaattctagattgaacataaacccccccccattgagaattgtttcgttttaaacaaactcattaacgctgggttggttgccacaacagcggcattatcagcaatcgctgcctcacccgcataagctcgtcctaaaccggaactggacacctcggcgagttggaaagctgccgcattggcataagttgtggataatgctagtgctgacgcaataagcgttggcgtaaaaaagttttttgtgaatttcatttttttcataagcaatatagataatcttagttgttaaaagtccatcgaattctaaaacatggttatgacatgagcaaataagtttacgccattaggtaagaggtcagatcagttaaatagggtttatcttttttaacctgttacattttatgacaaaaagagcggtccaaattggcttggaagttggagcaaaattaaaatgatgttaaaatttcaccaattttttaattttaaatcaaggaaataacgatgtcagaaaatgtattgaaatgtactccggaggaaactaaggcttgttgttgtgcagatgtgggaacgattatagataattcggaactcagcgtagacttttctcaagtctatgaaaatgaaacaacagctcaagaggcattggcatatttaacggaaaaagccagaaaagcggaaacggaatcttgtgacattcgtagcgagattaaggaagtaaacggcaattatcagcttaatgcaacgtttacttttagctgtcaagcagaaacgctgatttttcaattatctataagatgattgaacaaatgaggaatcgaaaaaggatcatgttgcccgtagcacgagttaaggcaatatgtaacgatcaagaattgtaacttgttgagaacgtgttcagaataggaaaatgttcaaataatgaacaccccatattacgtcgaggaaaataaatgttttatattagaaaagccaatgaacgtggtcatgccaatcatggttggctagacagttaccatactttttcattcgccggctactatgatcctacatttatgggattttcatcattgcgggtcattaatgaagatcgagtcaaagcagggttcggttttggtacacacccacataaaaatatggaaattctttcttatgttttggagggaacgattgcacatcaagatagtatgggaaatgtgcaaacaatttcagcaggtgaatgtcaaattatgtctgcgggtacgggcataacgcattcagaatttaatccaagcagtacagaaaatttacatttttatcaaatttggattcagccgaatgagttaaatattgctccacgttatgaacaaaaagcgtttgctcatcacgaaggtgcaactttgattttgtcacctcatgcggaaaatggggcattcaaaatttatcaagatatgaaattatggcgttatcaattaagagcaggcactcaaactgatattacgttggatagtaaccgctcttattggatacaagttgttaaaggcactttctttatcaatggtcaaacagtttcaacaagtgatggtgtggcaattaaccaagaacgtttagcgaagattgagacggaaaatgatattgagtttttgatatttgatttggcttaaaaatttttgggattcaatgttgagcaaattcaatgttcaagcaaaataaaaatgcctgtctttgatatatttcaaaagcaggcatttccacaatgttcgagtaatgcttaaaaactcaccgcacttttcagttttttcaacgcatttgtttcaagctgacgtacacgttcagcagaaatgttatattttgctgcaagatcatgtagtgttgctttttcatcatctaaccagcgtgatttaataatatcttgactacgttcatccagttcagctaaggcgttggcaacctgatctgctgcttgtgtctcaaaattttcgttttctagctcagccgcaaaatttgagcttttatcttctaaatagagtgctggtgcgtaactttcatcatcatcaacgggtaaatcaaaaccgacgtcagatcctgtcattcgactttccatctcaaggacatcttctttggaaacgcccaattcatttgcaaccatatcaacttctttatcactgaaccaacctaagcgttgtttagttttacgtagattaaagaataatttacgttgtgctttagttgttgcgactttaacaatacgccaattacgtaatacatattcatggatttcagccttaatccaatgtactgcaaaagaaaccagacgaacaccaacttcaggattaaaacgtttcaccgctttcatcaagccgatattaccctcttgaataagatcggcttgcggtaaaccataaccggaatatccacgtgcgacatgaataacaaaacgtaaatgggacaaaatcaatgtttttgccgcatctaaatcttggtgatagtacaaacgttccgccaattccttttcttcttctgcagtcaacattgggtaatcataggctgcgtggatataaccttcgatactgccttgcggaactaacatcattgcttgtgtttctttattcattctattcctttttgtttataaaagacttattttctctatactttaagacttttaattgttttaatcaattaatatcttaaattctaatagttagaccataaatacattaaaaagttttcgtgttattttaaaattggcacaagaacatattctacattttgttcaattacttgcaataataaatcaatatttgggtgcttccctggattttctttggcatctaaaacatgttcggcaaatagttgcacgcctttttccgcacaagtgcggtctaatttatcgttaaatttttgagccaacgcattataaacacgcaaagaacctaattttccctgctcggcaggaatatgatgcacgacttgatcgtttgctaatatatctaaaccggacaagtgttcaatactgggtaagctcgttaaaattgtttggaaatccattttatttctccattattatgaaatataagcagtactatccacttcaccgttttccccaataaagcgtacttccggttgtaaatagacgttaaattttagtattaccgtttggtgaatatgctgtgctaatttaaccacatccgcactacttgcattatctttattaataatgacgagtgcttgttgctgatgaacagcggcaccgccgatttgatagcctttaagtccggcttggtcaattaaccaacctgccgctaacttaattgtgccgtccggctgtggaaaaaaaggtatagttgggtaatcttgttgtaaaagcgaaaatgcttgtgctgaaataatcggatttttaaaaaaactaccgctattaccaaactcatcgggattgggtaatttgctttggcgaatatgacaaatttcagcaaaaatttcttgtgcgttgacttgatgtgtatcgaattcagttaatgtgccgtattttaatactggttgccaattttttgctaattttagaccaactgcggtaataaaatacccttctctgtattgccttttaaaaatactttctcgataagcaaacgcacattcttcattgcttaaacgaaatattgtatttttttgtaaatccaatacgtccacataatcacaaacatctttaaattctacgccataagcaccgatattttgaatgggtgccgatcctgcacaacccggaatcaaagcgaggttttctaaaccataaatgccttgtgttaaggaccattgcactaaattatgccaattttctccgccattaacatgtaaataatgaaagtttgcatcttgcttatgtttaatccccataagctgattaataaatacaatgcctttaaaatcgtccacaaataaaacgttacttccttgtcccaaaaataagatcggcaaagcgttctttttcgctaatttccattgctcaattaactcggaaagtgcggtgatttttataattttttttgctttagacggaagatgaaatgtgtgaaagtcttgtaaattttccattaatattccttaaaatgtattcggtaaagttaatttcacttcggtaccgcctgtcgaatgattttgaatagacaagcgtgcatttaattggttactgcgttctaacataatatttaatccataatgcccggttggttcctttaaacttggaataccaatgccattatcacgcacagccaattcatattcaccgtcatcattagtataagccagcacttcaatttctgtgccttgtgaatgtttaatcgcatttaatgtcgcctctcgcacaatttgtaacgcatgaactagttgttgggcgttaaatgtttgtgaaggcaaagaacaatccactcgcattcgcattgaggtttgattgcgtaatgaatctatcacttgttctaaagcaacctgtaaatttgcctcttgtatggttaagcggaatgtggcgagaagttcacgcaactgtagataaccggcggtaactgcttgctcaaaatcttgaataatttcttggcttttggctttggcatcttgagtttcttgttgtagggtatgttttaataaagtgagttgaattttcaaataagacaatacttgagccaaagaatcatgtaattctcttgcaataattgaccgctcttccatgagtaataaatgctgttgttgtcgttgcatttggtaaaaatacagcgtgcgactgagcatttgcgagacattgtgcattgtgcgtaaatccggacaaggtaagcctgcttgccaacgcataatcccaagttgattattttcgatttctaaatccatactttgtaaatcaacggggtcttgttttgttcctaaagaaatatgccaatgctctgcaccatgaacaattaattctaaataccgcaaatgttcattaatcatcacttgttttagcatttgttgaaatagtttaggttcaatggcttttgtagtaacaagttgagaacaatgataaagcatggttaaagagcggttagcttgacttaacttttgtgttttctcattcactttttcctccaacgtggcataaagtttttttaactcggctgccatttgggtaaaaactaaagctaatcgaccaatttcatcatcacttttggtgtctaacggaatatggttaaattgtccaatttgaacttgagaacttgccaacgctaatttttccaatggggtaacaactcttttgcgtgtaaaataaatgacataggataccatagctaaaatcacaatcattgctactaaaatactgagtacggcgattttaagtttcagctccgcaaaatactgtaaagtatttacaaattgatctacttgatcgacatagctggcgatttctgcacggtaagcatccttgttgttttcttttgcatgcttttccatgatctcccaacgcttgattaaattacgataggattgccttacatcattaggtgcaagaaaatgccgactgattttgagtaatggctctgaatgcaaacttaaacgatattgacgtaatgccctctctacattgtccggttcatattccatttcataaaaaagtcggtaactttgcatacgtaatgagccggaaacattgattaactctgcatcagatttattactttgcataatagctaaactcattatgctaattaacgatacaaaaataatgatgagcaataaatagttggcaattttagttgaaacagaatgattttttatattcatataaacgtttttaagcaaaaatctcaccctatcatacaacagaatgtattgaataccgcatactttattattcatgccgatggcttatcatatactgactgtattcaactttaatatcatcggcaaattccctcaaaatacgccatcaattttgctataatactccccgcatattgagggcagaaacaatggtaaaaaatagcacaatcaatcaacatccggaacaacaaaccaaagacattattgacgaaaaactcatacaagcaggttggcttattcaaacagttaaagcttataatcctaatgcaggtttaggcattgccgtgcgtgaatatcccaccggcacaggacctgtggattatctgttgtttgtggatagagagcctgttgccattattgaagccaaacaagaaaatttcgcctacaaactcaacaccattgaagagcaaagtgcacgctatgccaaaagcgaactcaaaaacattgcccaagccgacatcgcttttttgtatgaaagcacgggtaccatcacacgctttactaattgcaatgaccccacgccaagagccagagaagtattcaactttcatcgccccgaaaccttacaaaaatgggcaactgaaggcaaaaacaccttgcgtgctaaattaaaagcactacctgtactcaatccgcaaaatttgcctgcttgtgagttaaacttgcgtgattgccaactgaccgccattgaaaatatacaaacttcgcttgctaaagatttgccacgtgccttaattcaaatggcaacaggtgcaggcaaaacttatactgcgattaacattatgtaccgtttgctcaaatacacaggcaaacggcggattttgtttttggtggacaccgtcaacttgggcgaacaagccgaacaagaaatgctggtttttactccgccggacgataaccgtaaattcaccgaactttacaacacccaagtcatcaaatcaccacatatccctaaaggtgtggaagtgtgcatttgcactattcagcgtatgtattctttattgaaaggcgaagatgtagctattcctgatgacagcgttgaattggaagaatgggaaaaccgtttaaaagaacctttatccgttgcctatcaacccaatttaccgcccgaattttttgattttatttttattgatgaatgccatcgatctatttacaacttatggcgacaagtgctggattattttgatgcctatttgatcggcttaaccgcaacacccgataaccgcacttttggttttttcaatcaaaatgtggtcagtgaatatagtcacgaacaggcggttgcagacggcgtcaatgtgggcaatgaagtgtttttgattaacactaaaatcagcatacaaggcggtaaattcaaagccgaggaactggtagaacaccgtgaacgtactacacgccgtaagcgttggcaacagcaggacacagacgaaagctacactgccaaacagcttgatcgtgatattgttaatcctagtcaaattcgcacaattatccgcactttccgtgatcatttgccaatcatatttcccaatcgtcaagaagtgccaaaaacgctgattttcgcccaaaacgacagtcatgctgatgacattatcaaaatggtgcgtgaagaatttgggcagggcaacgaattttgtaaaaaaatcacttacaaagctaaagacgatattttggacgaaaatggcgatattgtagagcaaggcgaggagccgaaaaccattcttgccaatttcagaaacagctatcacccacgcatagccgtgacggtggatatgattgccacaggcaccgatgtgcgtccgcttgaatgtttgctgtttatgcgtgatgtgaaaagtcgaaattattttgagcaaatgaaagggcgtggcacacgcacgcttgataaagacggtttgcaaaaagtcagtccgcccgcaccgtctgccaaaacccattatgtgattgttgatgcgattggtgtaaccaagtccttaaaaacctcaagtattcagttagacaccaagcgttccgtgagttttgccgaactgggcagagcggtggtgtttggcggagcgtttgatatggacagtattagctcattggcttgtcgtttgtctcgtttggacaaacaattaagccaagatgaacagcagcaaatcagtgaaattctaggcggtgttgccttatcacaagtggtcaaagacttgtttcacgccatcaatgccgatgaaattcacaagcatgcttgcgaacaagagggtatttcccttgatgaaacgccgtccgaagaaacgctattaaaagtgcaaaagcaacgtgttcgcaccgctactaaaacactttccatggagctgattaccgctcttgatgaaattcgcaaacagcacgaacaaaaaatcgaccacgaactggacgaagttacccatgtgggctgggcggaaaatgacgaagcgattacccaaaattttgcagattggataaatgaacataaggacggcattaccgccctgcaaattttttacaaccagccttatcaacgccaagcatttacccttgcaatgataaaagagttggcaaacgcaatcaaaaaagccaaacccaaactggcattcagccacatttggcaagcctacgcacgcctagaccaagtcagcgagcaaaaacaaaatgaactcactgcactagtcggtctcattcgtcgcgtggtgggtattgataacaaaatcacaccatttgctcatattgtgcgtaaaaatttccaaaaatggacatttgagcataatgcccgagcagacaaaaagctcaccgaagaacaaatggcgtggcttgcgatgataaaagaacatatcatcacttcattttcgataaaaagcgatgactttgaactcacaccgtttaatcagcacggtggattgggacaagcctatgatgtgctttgtggcattacccaaaatgacgattttgacgcattgcttgatgaaattaaccaacgatggacagcgtaaccgaaaacagggcaaaaataatgagcgatttaattatttaccaaaccgatgacggcaaaacccaagtcagcctattggttgaacaaggcgaagcgtggctcacccaaaatcagcttgccgaactttttgatacctctgtaccaaacataaccactcatattaaaaatatattacaagacaatgagttagatgaggattcagttattaaggattatttaataactgcgtcagacggcaaaaattaccaagtcaaacattattcattggcgatgattttggcaatcggttttcgggtgcgaagcccacgtggtgtacaatttcgcaaatgggtaaacagcacactgcaaacttatctagaaaaaggttttttgattgataaagaacggctgaaaaatccacaaggtcgccttgattattttgatgaattattagccgatattcgtgaaattcgtgccagcgaaatgcggttctatcaaaaagtgcgtgaactgttcagcctgtccagcgattatgacaaaacagacaaagccacgcagatgttctttgccgaaacacaaaacaaactgctctttgccgttacgcaccacaccgccgctgagctgattttaagccgagccgatgccgatttaccgaatatgggtttgactgcttggaaaggcaaagtggttcgcaaaggcgatgttgtgattgccaaaaattatctaacggcagacgaattggacagcctaaaccgtttggtaacaatttttcttgaaagtgccgaattgcgtgtcaaaaatcgccaagatttaaccttgtcattttggcggaacaatgtggataatttacttgaatttaacggatttgccattttggacaatcaaggcagtcgcaccaacgcccaagcccaaaccatagctcacgagcgatacgagcaatttcacgctaagcgacaagcccaaaaacttatcaatgcagacagtcaggactggcaagaattgcaaaccctagaaattgaacttaaaaaagcgaaataacccaacgatgagcaagcatacaatgaccgcaaacaacacattaccgcaagggtggaagaaatataatttatttgaaatttgtaaacccaaacaatggaaaactattgcagtaaaagatttaacagatacaggttaccctgtttatggtgcaaatggtgttattggctattaccataaatataatcacgaaaatgctactgttctactaacttgtcgtggagcaacttgtggtgaaattcacatttccaagccatattcatacataaatggcaatgcaatgtgcatggataatttatctgaaaaaataacaattgaatttctgtatttttatttaaaatcaattaatttaagttttattatttcaggttctgcacaaccacaaattacacaagttggactaaaaaaactagaaatcccggttcctccattgccaactcaacaagccatcgtcaataaaatagaaaccctatttgccgacattgatgcagggatagatagattgaaaacggcacaaaagcagttaaaacaataccgccaatccttgctcaaaaatgcctttaatggcgaactgactaaagattggcgtgaacaaaatgctgataatttgccgtcatcaagcgaattactcgcccaaattcaacaagcaagggaagctcaccacgccaaacagcttgccgattggcaaagtgcggttgaaaaatgggaacaaacaaggaaaattgggaaaaaaccgagtaaaccaaaagcccaaacacaagcggttcaatttgaagaaagtttggaagatttgccaagtgggtggggaacaatcaaaatcaatcaagtggctaatatttttacaggtgcgacaccattaaaaagtaatcctaattattatataaatggttcaattccttgggttacaagtggtagcttaaataatgcatttgtagaatgtgctgataattttgttacagatttggctttaaaagaaaccaatttaaaattattgccaaagcatactttacttattgcaatgtatggagaaggcaaaactcgtggaaaatgttctgaattattaattgaagcaacaaccaatcaagcgattgcaggaattgttctttatgaaaattttccaatcagcagacaatttttgaaattctatatgtttaaaaattatgcagatttacgccgacaatcatctggtggagttcaaccaaatttaaatttaagtttagtgggaaatattgtttttccttttccctgcttaaccgaacaaaccgaaattgtccgtattttggaaagcaaactttctgcctacgaccaacttgccaccacattaagcaaacaacttaaacaagccgaattgttaaaacaggcggtattgaaatcggcattttcggctagattggagattgatcaagggggcgataagcaatgttaaattggaatgatattgaacagatgctaatcagtggcaatctatgccaagaaaagctttatttggagtataaagaagcaaaaaacgatgtacccaaagcggtatgggaaagctactctgcatttgccaaccaatcgggggggctttattttgctcggggttgccgaaaaaccaaatctgcatatttccggcgtgggtaatcctataaaaattcaagatctcttgttctcacaatgctgaaatgtggaaaaagctagttgtgctttgctcaatagcgatgatgtccgacaatttgggatccaaggcaaaacggtgattgctgtttatgttcgcaaggcggaaacaacacaacgcccagtgcatctaaatcaagattatcgccgctcttttattcggttaaatacaggcgatcatcggctcaacgatagcgaattgcgttctttcttaatctagctatacccataaagattttgatgggcatattttaccctatggcacattggattatttgaatcgagaaaccttgaacaaatatcgccatttattaaaagcacataatccttcatcaccattattgattctttctgatgaacgctttgccaagaaggctgggattttttccattgatgccacaacaggcaagcaaggtattacctacgctgctttgctgttatttggcaaaggggaggctattaaaggtgtttttccgcattttttctttgagtatattgaaaaaagcgaagagaaccgccgttatgatctccgtattacggattttgatcttgaagatggcaacttatttgagttttacctaaaaattgaaccgagaattattgcactgggcaaggatactcatttcaaattagataaactcacacgcacggaagaaaatgaaattaccgaagcattgcgagaagccttggtcaatgccattgctcacgcagactatttcaataatgcacgccatctgaaaattgtgaaaacgaccaatcaaatcagctttgaaaatgcggggataatgttggtggaggttgagcaggcaattcttggaaaccgttccgaatgtcgcaatggcaaaattcacgacctcttacgacgtatcggcttatgcgaacggcaaggcgagggtgtgcgagatattttcgctcattggaaaagccgttatttcaacacgccaaaattagaaagccatattgatcacaccaagctcacactcacttttcaagatggtgaaattgcaaaatggcaggaaaaattgactgcttgcttgggaaaagattttctaaaacttaaagaaatcggcaaagattgcctgctttatattgccgtaaacggtcaacaagcaagccataaacacatgacagataaaatgcctcagtattcttctcgtgccattacccttgctttagcacagttaaaaaataaaggtttattaagtgtatcaggtgaaaaacgtagtgaccgtgtttatcatcttctagagctaattgcagataagtcaaaatgtgattatgtggataacagcctaaccgtacaagataaaactattgaaaatcaaatggttatagagaataactcgttgggttatatacaagataggatacaagataggatacaagataatcttgcttctttgttggaaattttaaatgatactgcgtacagtacgagtgaattattaacattgctggcgttaaaaagtcgtccaagctttgtcaaaaattatcttaataaagcattacaggcggagttaattgaaatgactattcctgacaagccaaccagccgtaaccaaagatatcgattaactcggacaggtaaacagcttttagcaaaattgaaaagagacacacaatgaccatacaaacacacacctcaaacgccattgtccaaaaagtttggagtttttgtcatatgctccgtgatgacggcgtgagctatggcgattatttggaacagattacctatttgattttcttaaaaatggcatttgaatacagccagccaccctataagagaaatgtcggcattcctactgaatacaactggcaaagtttgattaaccgttcggggatggaattggaaagtcattatttggcattattgcgtgatttaagctagaaaaaaggcttgcttgggcagattttcgccaaagcacaaaacaaaattcaagaccctgccaaactttctcgtttaattgcgatgatagacgaaaccaagtggacccgtttaaatactgatgtgaaaggcgatatttacgaaggtattttggaaaaaaatgctgaagacactaaatcgggagctgggcaatattttacaccacgagccttgattgcagcgattgtagaatgtgttcgtccgcaagccgatacgatcattgctgacccggcagcgggaacaggcggttttttattggcagcatacagttatttagaaaaacataccaatttaaacgctgaacagaaagtgcggttaaaaaaagggactttttttggcaatgaaattgttgccaatacccgctgtttgtgtttgatgaatttgtttttgcacggtattggcgaaatggacggtgaaagtccgattagctctgatgattctttgcttgcaccaagtagtcgaaaagcggatttggttttagctaatccgccctttggcaaaaaaagcagtatgacgtttaccaatgcggacggtgaagctgaaaacgaagattttgtttataaccgtcaggatttttgggcaacaactgccaataaacaggtcaattttttgcaacatatttacactatgcttaaaaacaatggtcgtgcggcggtagtggtgcctgataacgtgttatttgaaggcggtgcaggcgaaacggtgcgtaaaaaattgttgcagatgacggatttgcacactattttacgtttaccgacgggtattttttatgctcaaggtgtgaaagcaaatgtactgttttttgataatcgcccaactcaagaacaggcggttaccacagaaatttgggtatatgattaccgcactaatgtgcatcacactttaaagaaaagaccaatgcaattgactgatttacaagactttatcaattgctattgtgctgatgatcgccgtaaacgtacggaaacctatcacgccgataacaatcctgacggtcgctggcgtaaatttacccttgatgaaattaacaagcgggagaaaaccagtttagatattttttggttaaaagatcgttctttgaccgacttggatcatttgtcggaccctgatgtgttagccaatgaaatcatagaaaatatggaaatagctttgatgaattttagacgtgtagcacaggaattgatagataaatgaaatgagttgtcctcaaacaccgtttacagaaatgtaaacggttttttaaataaatcaatgatatatcatttttctcaagcatatccgcaattccacgcttcgtaacttcctatactgaaatcataaatttgatctacctcaacaaacttacattttgtcgagcaaatactcatttttggttattaaaaatcagcggtaaggtttggataataaaaatctataaaagaatagtgtggtttttaggcataacgttggtggaagaacagttatccagcaacgataacaacctcaaaataagaaagaatatgaaagaaaataaaaacgcaaaaaatcatgctgaggagtggcatgtttgtggcttaattattcaagtaaacccacaaaaaatagcacaagttaagaccgctcttttgacgattccgcatacggaaattccagcagaggatgaaaaaggaaaattggttgtggttatgcaatcggacgatccgcaggttttactgaatcatatggaaaattcacgcaatattgatggcgtgattgatttgtcgctgatttatcatcaacaagatgacaatgttgagcaataatttaaaaatgaatagtgggggagactatgaatttaagtcgtcgtgattttatgaaagcaaatgctgctttagctgccgcttcagtggctggcttaattattccggtaaaaaatgtaaatgcagctgacacaagtattacttgggataaagccgtatgtcgcttttgcggtacaggatgtgcggtattagtggggacaaaagatggacgtgttgttgcttcgcaaggtgatcctgatgcagaagttaatcgagggttaaactgtattaaaggttatttcctacccaaaattatgtatgggaaagaccgtttaacgcaccctatgctacgtatgaaaaacggtcaatatgacaaagaaggggaatttacccccgtaacttgggattttgcctttaaaacaatggcggaaaaatttaagtctgcattaaaagcaaaaggaccaaatggtgtaggtatgttcacttccggacaatccactatttttgaaggtgtggcaaaatcgaaattattcaaagcaggattactttcaaataatattgatccgaatgctcgtcactgcatggcatcggcagctgttgcctttgtacgtacctttggtatagatgaacccatgggctgttatgatgatattgagcatgccgatgctttcgtgctttggggttcaaatatggcggaaatgcacccgattttatggtctcgtatctcggatcgccggttggctaatcctgatacagttagtgtaaatgtcctttctacctttgagcaccgctcttttgaacttgccgatttaggtatccttctcaaacctcagtctgatttggctattttgaactatattgcaaattatctcattgaaaataatgcaattaatcgagagttcatcgaaaaacataccaaatttaaacgtggcgaaactgatattggttatggcttacgtccacaagatcctcgtgagcaaatagcgaaaaatgttaaaactgcgggcaagatgtatgatagttcttttgaggaattcaaaaaattagttgcaccgtacaccttagaaaaagcacatgaaatttccggagtaccgaaggagaaattagagaaactggcaaaactttatgccgatccaaataaaaaagttgtttcttattggacaatgggtataaaccaacacacacgtggtgtatgggcaaaccatttaatttataacattcatttattaaccggaaaaatttcattaccggggtgtggtcctttctcattaacaggtcaaccctctgcttgtggtactgcacgtgaggtgggtacttttattcatcggttaccggcggacttagtagttattaaaccggaacatcgtaaaattgcagaaaaaatttggaaactaccggaaggtttgatttcagataaattaggcttccacgctgttgcacaaagtcgtgcattaaaagacggcaaaatgcaggtgttatggcaaatgtgtaataacaatatgcaggcaggtccaaatatcaatgaggaaacttacccagggtggcgtaatccggataactttattgtcgtttcagatccctatccaaccgtatccgcactttcagccgatttgatcttaccaacagcaatgtgggttgaaaaagaaggggcttatggaaatgcggaacgtcgcactcaattctggcgtcaacaagtgaaagcaccgggtgaagcaaaatctgatttatggcaattagttgaattttctaaatattttacgactgatgaagtatggccggcagaaattttagcgaaaaatccggcataccaaggtaaaacactttatgaggtgctttatctcaatggacaagtaaatcaatactcaaatgatgaactgaaaggtcgcctaaatgatgaggcttaccattttggtttctatatacaaaaagggttatttgaagaatacgcaagttttggtcgaggacatggtcatgatttagctgattttgacacttaccataaagctcgaggcttgcgttggcctgtagttgacggtaaagaaactttatggcgttatcgtgagggttatgatccttatgtaaaagcaggggagggtgtttctttttatggtcaggcggataaaagagcggtgattttagcggttccatatgaaccgccggcagaggtgccggatagagaatatgatttatggttgaccacaggtcgcattcttgagcattggcatacaggctccatgacacgtcgtgtaccagaattacaccgttctttcccgaataaccttgtttggatgaatccgaatgatgcgaaaaaacgtggtttgaaacatggggataagattaaggttatttctcgccgaggtgaaataacgtcttatatagatactcgtggacgtaataaatgtcctgaaggtttgatttatacgactttctttgatgccggacagctggcaaataaactgatattagatgcaacagatccgatttcgaaagaaactgacttcaaaaaatgtgcagtaaaagtggtgaaagcgtaacaatcaacaaaaggcaccgcactttacttgctaaagtgcgatgaatattcatgaagaaaattgcttttacaccggaacgccgaaaatttttaagagataccgcccgaacctgtggcggacttgccggattaggcgtattacttggcttacaacaacatcaaagtctggctagacagggtgtggcattacgtccgcccggtgctttggctaatgaccaagattttacagcggcttgtattcgttgcggtcaatgtgtacaggcttgtccttataaaatgctgcatttagcctcattattatcttccatagaggctggaactccctattttattgcgagagagaaggcttgtgaaatgtgtgaggatattccttgtgttaaggcttgtccgagcggtgcattggataatcaacttgatgatattagtaaagcaacaatgggattagccgttttgcttgatcacgaaacctgtttaaactggcagggtttacgttgtgatgtttgttatcgtgtttgccctttaattgataaagcgattacgttggaaactcatcgcaatgagagaacaggaaagcatgctgtgtttattccaactgttcactccaatgcttgtacaggatgtggtaaatgtgaagaggcttgtgtattggaagaagccgctatcaaggttcttcctaatacattagcaaaaggtatgttgggagaacattatcgtttgggctggcaagagaaagataaagtagggcattctcttgcacccaaagacttaatatccttaccaattcgtcaaccggagagtaaataatggcaaattctcctaaacacagcggtaaagaattaagagaaaaattaggtttttggcgtgcaaaccggttcctcattttacgtcgggtaactcaattcagcattctcaccatgttcttgagcggaccttatttaaacttttggattctaaagggtaattatagtggtagtttattattcgacactatcccattaaccgatccgcttattgtcgcagaaagccttgcaacaggctatttaccgaacagttcaacgattattggaacaattattgttgtatcaatatatgctttacttggtagcaaagttttttgtggctgggtttgtcctcttaatgttgtaacggattgtgccgcttggttacgtcgaaaattagatattcgtcaaagtgccaaacttcctcgtggcttgcgttatggtattttgctgatgattttaatggggagtgcagtaagtggcgtattgttatgggaatggataaatcctgtttccgctttgggacgtgcgttaatttacggggttggtgcaacaacttggttgatatcggcagttttcttatttgacttatttattgtggagcatggctggtgcggtcatctttgtcctattggtgcaatttatggtgtgattggggcaaaaagtttattgcgtattaaagtagttgagcaacaaaaatgtgatcactgtatggattgttaccatatttgtccggagccgcaagttttacgtgcaccgctacacggtaaaaataatgaaagtcggtttgtactttcaaaagattgtatcagttgcggacgttgtattgatgtctgtgctgaaaaagtatttatatttagcaatagatttaatcattctgggagtgatcaaaaatgatgaaaaaaacactattatttattaccgcactttttgtgtcttctgcttttgcaacgcagaaagtaggaaaaaactaccaagatgctgttgaaaatgtgccagctgcatttcataaccatataaaagaaagtacaacgcccgcattaaactatgtaaatcaaccacctatgatcccgcatagcgttgcaaattatcaagtaacaaaaaatacaaaccagtgtttaaattgccatagtccggaaaactcgagaattaccggagcaacaagaattagtccaacgcattttacagatcgtgacggcaatgttaccggtcaaactgcaccacgacgctatttctgtttacattgccacgtatcgcaagcagatgttgctcctattgtgccaaatgaatttaagccaatgaaaggctatggtaactagatgaggatagatgtatggcaaatgaaaaatcaaatatcatcgttcgtttaagtaaaagcggttggaaatggtttaggaagccaagtcgtgctgtcagtgtattgattttattatcatttattgcaggtattattttttggggagggtttaacaccgcatttgaatacacgaatacggaagaattttgttccagttgtcatatgaatgatgttgtacctgaatatcgtcattctgttcactatatgaatcgcagtggagtaaaagccgactgtgccgactgccatttaccgcacgaatttattccgaaatggacacgtaaaatcggggcggcaaaagaagtttatgcgtatattacaggcaaggtagataccaaagagaaatttgaggcacatcgcttagaaatggcacaacgtgaatgggctagaatgaaagccaatgactcacaagaatgtcgtcattgccataatttcaatgatatggatactactcagcaaaaaaatgtcgcacaaaaaatgcacagaatggcacaagaacaaggaaaaacctgtattgattgtcataaaggtattgctcaccaattaccgaatatgaaagacgtgcaatccggttttttacctgagcaatagtgaaaaaattgaccgcacgttgagttgcacctccaacgttggatacatccgactgattgaggtgcaacattgtgactatttgattttaaattatttatcctaatgcaactctcgcattttggaataaacgcatccaagccccgtcttcttgccaattttcaggataccaagaattgtttactgctctaaatacacgctcagggtgtggcatcataatagcgactcgtccgttggaattagaaagtgcggtaattccctccacagatccgttcggatttgccggatacatttctgtcggatttaactgactatcgatatattgtgcagcaatcaaattctgtgcttttaatgcttgcaactgctgatcatgcttaaattcaattcgtccttcaccatgagaaaccgcaatcggcatatgtgatcccgacattccgttaaaccatacggaatgagtatcgttaatgcgaaccattgcaacacgagcttcaaaacgttctgatttatttcgtacaaatcgtccccagttttccgtaccgggtataatttctgctaaattggataacatttgacaaccgttacaaacacctaaggctaatgtgtcctgacgatggaaaaatgcactgaattgatcacgaagtgcagtgttaaacagaatagatttagcccaaccgccaccggctcccaagacatcgccataagaaaatccaccgcaagcaacgagtgcgttgaaatcctgaagatgatgacgtcctttttgcaaatcactcatatgaacatcaatggcattaaatccggcacgatcaaaagctgccgccatttcataatggctgtttaccccttgttcacgcaaaatagcaatacgaggttttgttcctttttggatataaggtgcggtgattttttcatttagatcataggtcaaataagcggaaagtcctttatcattcggatcttttttcatctcaaattcttgatcggcacaatccggattatcacgtaaacgttgcatttgatgtgttaattcagcccaaatcccacgtaatacggaacgtttttcactcaataagactctggtactgcgagtaatctcgatatgatcatctgcggtaacaataccgagttctttggttaaatgaattaatccatgttcggtcaatacggcacgcaccgctttaaggtcactttctttgacttgaattacggcacctaattcttcattgaataaaacaccgagatcattgtcacccaatgcactgatgtctatggaaataccgcaatgaccggcaaaagccatttccgcaagcgtaacaatcaaaccaccgtccgaacgatcatgataggccagcaatttctcttgtttcacaagagcttgcattgcatcaaaaaagcctttcagcaaagacacatttaccacatctgccggtacatcgcccaattgcttatacacttgagcaagtgcggttgcacctaaacgattttttccctcacctaaatcaattaatagcaatcggctatctcctttgtccagacgtaattgaggtgtaaccgtcttacgcacatcttctacacgagcaaacgcactgataattacggaaagcggtgcggttacggatttttgatatccttcttcctgccaagtggttttcatagacatggaatcttttccaaccggaatggttaaacctaattgagggcataattcctcaccgattgcttttacagcctcataaagtccggcatcttcgccgccatgacctgcggcagccatccagttagcggataatttaatccgtctaatatcgccgatatccgttgcggcaatattggtaatgctttctgcgacagctaaacgtgcagaggcggcaaaatccaacaaggcaacaggagttcgttctccgatagacattgcttcaccgtgataactgtctaaacttgctgttgttaccgcacaatccgccacaggtacttgccacggaccgaccatttgatcccgtgctaccatacctgttactgagcggtcgccgatagtgattaaaaatgttttctctgctacggcaggtaaccgcaataccctgaacaatgcttctttaatttggatcatagactgatccaattggggattattgacttttgcggatttcacattacgtatcattttaggggttttacctaacaagatgttcattggtaaatcaataggattgttattaaaatggctatcttgcaaagttaactgctgttgttccgttgcctcaccaatcaccgcaaaagatgctcgctcacgctgacaaatcgcttcaaagagcggtaatttttctggtgaaacggctaaaacataacgttcttgtgattcattgcaccaaatttctaacggcgacattcctttttcatcgcataaaatttttcgcaactcgaatcgaccacctcgaccaccatcatgaactaattcaggcatcgcattagataacccgccggcaccgacatcatgaataaaaagaatggggttttctgaacctaattgccaacaacggtctattacttcctgacagcgacgctccatttccggattatcccgttgtacagaagcaaaatccaaatcttcttttgactttcctgatgccatagacgaggctgcaccaccgcccagaccaatattcattgctgctccgcctaacacaattaatttcgcaccaacaggaatttcgcctttttgcacatgttcatgacgaatattacctatcccgcctgccagcataatcggcttatgatagccccgcacttcttcgccgttaaaactgttgactttttcttcataagtacggaaataacccaataaagcaggacgcccgaattcattattgaaagcagcaccgccaagcggaccttcaatcataatatccagtgcggaggcaatacggctcggtttactcaacgcattttcccaaggttgcggaaaattcggaatacaaagattagacacggagaaaccgactaaaccggctttcggttttgcaccacgtcccgtggctccctcatcacgaatttcgccacctgaaccagttgcagctccggggaaaggtgaaatggcggtagggtgattatgggtttccactttcatcaaaatatgcgtgtcttcttgatgataacgatattgcccgtcttggttagggaaaaagcgtccgacttttgaaccttccatcaccgcagcattatctttataagctgacaatacataatcaggcgttttctcaaaggtgtttttaatcattttaaacagcgatttatcctgtttttttccatcaataatccaatctgcattaaaaatcttatgacgacaatgttctgagttcgcttgtgcaaacatataaagttcaacatctgtaggattgcgaccgagtgcggtgaaattttccactaaataatcaatttcatcttttgctaatgccaatcctaaagtcacattcgccttttccaatgcaacatgcccaccggttaaaatatctaccgtggtgaaaggttttgggtcatgctgttcaaataaaacagctgcttcttgtggagaacggacaatactttccatcatagggtcgtagatacggaatactaattgttgttcttcttcagccgttaaagtgcggttaaatttgaaataataagcgataccacgttccaaacgaagtaccttatttaaatcacaattatgtgcaatatcagttgcttttgatgcccaagaagaaatcgtacctatacgtggaatcaccacaaaacattccccataaggctcttgcgatttctgagtcggaccataacgcaaaagctcctctaatttttctctttctacctcagttaatgcttcacttaaatgggcaaaatgcaaaaattctgcataacaagacacaatgggtaaattatcttgctgaaaaccactgaataactgatttaaacgaaaattggataatgcgggcgtgccacgaaaaatgtgtaacatagaaaagatccatcaaaaaaataaaaaacgaccacattataaaggaatttttatcggaacgaaaacgtttgcctaatgcaattttcaaaaaatagttaataaaaagctgataactgaaatgatctgcaccccaaaagttggactaaacaactaactgatgaagtgcagatttttttaggattaattttttggtaaatatctcattggatctactgattgacctttataacgaatttcaaaatggagtttgattgtgtttgttccagaacttcccattttagcaatttgttgacccgctttaacttcttgctgatctttgacgagtatactttcattatgtgcataagcacttaaataactgtcattatgtttaataataattaaattaccatatccacgtaaagcgtctccggcatatacaactcgtccagcagctgctgcattaacagcttgtccacgagaaccgctaatatcaatacctttattgcctccatcagcactggaaaatccttgaataatttttccatttgttggccaaatccaagctatatttgaggtggctggaggtgttttattgattggcattgttgaatgtgttggtgtagcaacgggtttcatttgttcatttgttggtttattagcattccatgtctcattgactgtattttgtgtcacctctgattcatttattgtctgtgttggtatcatattgctatcgggaatattatttgcaattttcaatacttgtccaatactcagatgatatggctcagacatattatttagtgtggccaattcttttatatccatgcctgaaatataagcaataagaaacatggtatcgcctttgcgtactttgtaagtatcacctttgtaaaaacccttatcaattttgctataaacaggcacattagttttaggatctcttggaatttcaaaattttgtagagcctgtttttttgctatcgattctgttttttgttgattttgttgaatgatttcaggttgataagtggagtttgttgctttcggcactctcatactttcgggcatcttttgttgaataacttgaggttcccaagcggttgagtttgtaccattaatcggtttgataatacttggtgctaaatccttagcattttctaccggagccggagtgtgtgaactacaagcagctagtacagtgatactaatagataaaggtaaaaattttttcatgtaaattctccgttactttatattcattttttatcttagattatttcaagacaagatatacaactatagcaataatgacaactgaccaaccgataaattcaatagattgacgtaatttcgcagcaaatttttttccgctccaagccgctaaatgggtaacgagcaaaaatcttgcaatacgagaaataaaggcagtaagtaagaaaggcaaaaatgccatttgcatgacgcctgcacaaatcgtaaaaattttataaggaataggtgaaaaacctgcaacgaaaactacccaaataccccattctttgaaccaagaaagagcagtttcccaatgttgttgataaccccattgttgaatataactttgtatgaaatcaaaagcgtaataacctaatccataaccaattgccccaccaatggctgaagccattgctgcataaaatgcaaatttagtagcacatttaggtttatttattgacatcggaataagcatgacatcaggtggtattgggaagaaaatagcctcaataaaactaacaaaagttagccaaaatgtagcaaaacggtgatttgcccattgcatagttttatcatatagcgtaccgaaaattttcatgttttattccttcgatgaaaagattatcgttattccttatctaaccattgttgtaaagctgtcattgaatgatatgccgtcatatctgtttgaatgggtgtaattgacacatagccgtttttaacggcatggaagtccgttccttccgattcattttctgccagtcctattggtccaatccaataaatctcttcacctcttggatctttttgtttaataatatccgctgcagctgcacgatacccaagatgacaaactttaataccttttatttctgaataggggagatccggcacattaatattaataatttctcggctttttaataatcgtccatatagtttaggaataagttgactcacaattattgccgcactttcataatgttgtcgtccatctaaagaaactgcgattgcaggtaagcttaaatggcgaccttccagtgcagctgcaacagttcccgaataaataacgtcatcacctaaattgactcctgcattaatacctgaaacgacaaggtcgatctgaccggataaaaaaccgttgagtgctaaatgtacacaatctgcgggagtgccattgatactataatcaccattatccaatttcattggtcgtaaaggctcaacgagtgtgagtgagcttgaagcggcactacgattacggtctggtgcaacaacagtgacttgtgcaaatttacgtaattctttagcaagagttttgattccctctgcctgtatgccatcatcattagaaagcagaatatgcatattatttcctatgttttaaattattattcattaatattaaccagttctcttactaaggctgtcgcataacttcctgccggtaaataaaaagtcagttttaatccctcaggtataaatgaccagcttaagtgttgagcttgcataagtattggacgacgtgccgatttcattttttcctggtgcattaagtacaggagttcttgatgtttagcgataatttcattttctacatcactggcaatttgtacattttcaccaattaatggtgcagtgatttgaatatcctgttgtgctaaacgttgttgtaataaattaaaatcttctttttgatcagcatggaaccaactgtgtgagccggataactgcaaaatatcatttactaagattttatggtgtagaccttgtcgaatacgagcggatacaatcaagttaaaaatttcactacgagcagcggagagataaaaactacgctttttgcgatctttaacgttaatttcacctttagcccagcgtaaagcctgagttaaattgtgtccatctcgtccgaaacgttgctcggtaaaataatttgggaacccatttttcttgatattttctaaccgcactttgagatctgcatcttcttgtgcttcacgcagtaaaatttcaaaatggtttccgtccaagcttcctgtgcgaatttttcgattgtgacgtgttacctcaaggatttccacaccatcaagttgaaattgattaaagtcaggtgtgggttgccccggcatctgtaaacaaaaccattgttctgtaatcgctttacgatctttgagtcctgcatatcccatatttttagcaggtataccagcaaagtgtgccaatttttctgcgacaaatagagtattacaatctgttttacgcactttaacagcaacaaattcgccatcaccggacatttcatagcccagttgttctttcacaacaaaatcagcacagtgtgtttttaaaagtgcggtctgttttggcattgtttgtaaataagcgagttcgttcattactttgtgccagtttgttttattaatagggcaacagcttcacaagcaatgccttcactgcgtccagtgaagcctaatttttctgttgtagttgcttttacattaacctgttcaatatcacaatgtaagtcttgtgcaatcacagtacgcattgagtcaatatatggacgcatcttgggagcctgtgcaatgatagttatatcaacattaccgacttgatagcctttgtctaaaattgcttggtaggctgttcttaataacctgcgactatcagcacctttatattgtatatcagtatctgggaataattttcctatatctcctaaagccattgcacccagtaaagcatcagttaatgcgtgtaatgctacgtcgccatcactatgtgcaactaaacctttttcataagggatagcgacacctccaatgataataggaccttcaccaccaaaggcatgtacatcaaagccatgaccaattcttatcatattttttcctaattaatgctcttttttcataatttgttggatttcagccatcatttcttggtcgacatctaaggctatttgaattaattctttattttcaaagcgagagagttttggatcataaacctctgccatcagtttcacgctatgacaatcttttctaaaatacacatcaccaatttctgctactatatcttcgttcatacctaaagagagtaaggcttgtttacttgttcttaatgccgagtcaaaggtttcacgaatttgaatattggcacctgcaccatacagattgtaaacatgaatacggtcgtgagcacgtgcaataattttaatttgtgggttcattttacgagcttgctcaacaatttgtagagtttgttcgctgttatcaattgctacaatcaataattcggcattttcgacaccggcagcatgtaatagctcaggacgagcagcatctccatagtagcatttaatgcctaattttttcataccggcaattaggtttgcgtctttatcaataatagttgggtgatgccccgtcatcactaacattctatttacaacttgtccaaaacgtcccagaccaattagtatagttggatgttgttcatcaatatgatccgcttttctttccggttgagtcggtttgagacgaggaataatgtatttcttttgagcaataataaagagcggtgttaaaatcattgaaagtacaacaatggctgtcatattcgcttgcatttctttactaatcacattttggctggctgctgaagaaaataatacaaaggcgaattccccaccctgtgccataataaatgctcggtcaatagaattagcattaccggtttttgtgattaaagcgattaaataaattataaatcctttcactaacatgaaaactagtacaccaaaaataattaagaaccaattttcagcaacgacggaaaggtcgagtgacataccgacacctagaaagaacaagcctaatagcaaccctctgaaaggctcaatatcagcttcgagttgatgacgaaaactggattctgaaagtagcactccggctaaaaaagcacccatagccatagagaagcccccctcttccataagtaaagcagagcctagaacaacgagaagagcagctgcggtcattacttctcgagtcttggttttagccaacattttaaataatgggtttaagagccaaagtccggctgccactaaaacagcaaaagccgtgccggatattgcaattttatgccaaagcggatcagttgaagtaactttatccggcgataaaaaagccacaaaagcaagtaatggaacaatgagtaaatcttcaaagagtaaaatcgaaataatacgctgtcctcttggagaggtcagatcattacgctcactcagttcttgcattacaattgcagtagaggtcaatacaaaaccggaggcggcaacaaaagcaactttccaatcaaagccaaataaagtagcaatataagttaaagcactggtacaaagggtaatttgaaatgcacctaagagaaagatatagttacgtagtccccagatatgagagggtttcatttcgagtccaatgatgaataaaaacatcaccacacctaattctgctatatggattattccctctggatctgtaaagagaccgaacccaaagggaccaataactaaaccggcggctaaatagcccaatactgaacctagtcctaagcgtttgaatagaggaaccgcaactacggccgccgctaaaagcgtaacaacgctaacaagtgggtttgccccttctgctaccataataattacctttgttttctagttaaaaaaaattctgccaatgccaagtcttcaggacgtgttactttaatattatcactatgtcctgctactaagtgcggtctaaatccggcaagttccatcgctaatgcttcatctgtgacgataatacctcgttttgctgcttgctctagagcgtgttgcaataagtgtacagggaaaaattgcggtgtttgtgccaaccataattgattacggtcttctgtacattgaatttgcaatactgaatttgatcgtttaatagtatctaccgcaggaatggctaaaatagcaccattttgatcttcaacttgtagtaatgtatctaaattttcattgcgtaaacaaggacgtgctgcatcatgcacaagcacccaggcttttttatttttaatgtgacgtaggccgtttagcacagattccgcacgattctttccgccaataaccatattgatacgaggatttcgcaataactcaatatcaattaaataaggatcattttcagcgacagataaaacaatttggctaattttttcgcaacccaaaaaaatacttaatgtatgctctaaaattgttttgcccagtatctttaaatattgttttgggcgatctgcttgcatacggcaaccaatgccagcagcaggtattatagcaacaatttctctatccatttatctattcttattttttactatacgataaaaaacttcattttgcttgatcatttcatgttccattctggctctttcctcgattgcttctataccattcttcagatcctgaatttcagcaaaaatagtttgattacgttgtgacagcttttggttttcttgtttacgttggataatttctactttgatatcttgataatcaagatagccattttttccaaaccaaaaatcatactgaaacataactaacaaagcgaaaagacttaaaataaataaacgcatttttatctcttatttttcataccaaattctatttatgtacaaagaaactatacctgagggagtggctactttgatttcgtcatcgacttctttgccaattaatgcccgtgctacagggctatcaatggagatccaattctttgcgggatcaaattcatcacagcctacaatgcgatattgtttttcctctccttgctcatcttctaaggcaacccatgcaccaaaaaagactttaccttcttgctttgggttatagtccacgatttgcaatacttccaagcgtttcattagaaaacgaactcggcgatcaatttctcttaaacgacgcttgccgtaaatatattctgcattttcactacgatcacccaaggcggccgcatcggaaacagcttgcgtgattttaggtcgttcgtctttccataaatattttagctcttgatctagaatattccagccggaacgagtgatataattagatttaggcattgtatctttcctttcaaagagagcgaaattgtaacataagatcaataataaatatgtgaagaatagttaaaattacagttaattttacaattttttccaataattgtttgaactattacgttaaactcagtatgctactgcgaattttttaaacagaatataatagaaatagagacaagatgttaaatcaacaaatcgccggtattattgcgaaagaattagctgttctgccaagtcaaattttatcggctatccaattattagatgatggcaatacaattcctttcattgctcgttatcgtaaagaaatgaccggtggattagatgatacccaattacgtcattttgaaacacgtttaatttatttacgtgagttagaagatcgtcgccaaacgattctcaactctattgaagaacaagggaaattgacagatgaattgcgtagtcaaattgaacaaacgcaaagtaaaactgaattagaagatctttatttaccgtataaaccgaaacgtcgcacaaaagggcaaatcgcaattgaggcaggaattgaacctttagctgatttgctttggaatgcacctgagaatgaaccggaaatcgttgcggcagattatatcaatgcggaacaagggtttgcggatataaaatctgtgcttgatggtgctcgttatattttaatggagcgttttgccgaagatgcacaattgttggcgaaaatccgccaatatttacagaaaagtgcggtactggtttccaatgttttagaaggcaaagaggctgagggagaaaagttccgagattattttgaacatcaggaattactccgcaatgttccttctcatcgtgctttagctatgttccgagggcgtaatgaaggctttttgcaattaaggttgaatgcggatcctgagcaagaagaaggtgtttgtcatagttattgtgaagaaattattcgagagcatttgggtattcatttaactcagcaaccagcggataagtggcgtgagcaggttatctcgtggacttggcggattaaaatctctttacatcttgaaactgaactgatgagcagtttacgtgagaaagctgaagatgaggcaattgatgtttttgcccaaaatctaacttcattattaatggcagcacctgccggagcgaaaaatactatggggctagatcccggtttaaggacaggtgtaaaagtcgctattgttgataatacgggaaaattagtggcaacagagacagtttatccacataccggacaaatgaatacggcaatgtcagttatttatcaattaattaagcaacataatgttgagttaattgccattggtaacggcacagcttcaagagaaactgaacgatttgctaaagatgttattaagaaaattgagcaaaataaaccacaaacagttgtggtcagtgaagcaggtgcatctgtttattccgcatcagaattggcggcacaagagtttcctgaactggatgtgtctttgcgaggtgcagtttctattgctcgccgtttacaagatccactggcggagttagtgaaaattgaaccgaaagcaattggcgttgggcaatatcaacatgatgtaaaccaaactcagcttgctcgtaagctagatgcggtagtagaagattgtgtaaatgccgttggggttgatttaaatacggcatcagcacctttacttgctagagttgcaggtatgactaaacatcttgcacaaaatattgtggcatatcgtgatgaaaacgggcgttttgaaagccgtaatcagttaaaaaaagtaccgcgtttgggtcccaaagcctttgaacaatgtgccggttttatgcgtattgcacaaggtaaaaatccgcttgatgcctctggtgttcaccctgaggcttatcctgttgttgaaaagattttacaggctacggaaaaatctattcaagatttaatgggaaatgtgagtgctgttcgacaattagatgcaaaacaatttactgatgagcaatttggaatgccaacagttttagacattttcaaagaattggaaaaacccggaagggatcctcgaggtcaatttaaaacggcggtatttatggacggtgttgaagaaatcactgacttaaaagcaggtatgattttagaaggatctgtaactaacgtaacgaattttggggcatttgttgatatcggtgtgcatcaagacggtttagttcatatttcatctctttccgacaaatttgtggagaaccctcatgaagttgtgaaaacaggcgatattgtgaaggtcaaagtgttggaagttgatgttgcccgtaagcgtattggactaaccatgcgtttagatgaaaacccgtccaaaaccgaccgcacttcagtcaaaacgacctcagtccatgtaaaagaagtgaataaaaatcggaaaagtagcaataatgttatgggaaatgcgtttgccgatgcgttaaaaaattggaaaaaatagttttagtacagggtatttgggtattaagttatgatgggtttaattgtataacacaggaaattttatatgaataaaaacactttttttgtaggctttatgctgtttgctatcttttttggtgcagggaacttaattttccctcccaagttgggatttgatagcggatctgaatttattccttctattttaggctttgtattaacaggggttggcttaccgctattgggcatcgttgttagtgcattttataatgggggatacaaagaagcacttaaacaaattcatcctgcattttcattaatttttttaattgcgatttatttatctatcggccctttttttgccggaccaagaaccggtgcaacagcttacgaatttgtgattctaccttttatgggggaagcaacatcaatttctaaactggtattctttgcggtctatttttcattgactttatggctaagtttaaatccgacgaaattagtcgatcgtatcggctctattttaacgcctattttattggtagcgattatcgcattagttatccgttctgtttttttattaagcggacatgatattccaagtgtaacggtgaatacatcaggtagcttttttaatggcgtgattgagggctactttactatggatgccctagcatccgttgctttttctgtggttgtgttaaatgctatacgaaataaaaccgacctaagtgcttcattaaaacagcaaacaatttttgctgcatttattgctgccattgccttgggtttaatttatgtagcattaggatggattggaaacaatatttcaattaatgcggatgtattagctgatttgcaagccaaaaaacaagaccttggtacttacattctaaacgatgtaactacattagcttttggtgagttaggtcgtacgttgttaggaattatcgtttctcttgcttgtttaacaactgcggtaggattagcggttgctgtgagcgaatattttaatgagatttatccgaagatttcttacaaaacctatgttgttttattttgtttagtgagttttgtaattgcaaatttaggcttaaaagaagttattagtttatcattacctgtattgctaatcctttatcctattgcaatgacagtgattttgttgctttttgttaatattattttcccgacgccaattttagctcatcgcttatctttaggattggtgactgtcgtgtctgttttatcggtatttggggttggaaaaattgagtttatcgagcaacttccactaaaaccttactctatggaatggctaccttttgcattggttggatttattttaggatgttttttacacatattcttcagtaaagaaaaatcagtgttaaaaagataagatataaaaatgagggcatattcaatgcccttattttctagtagtaagagtgttcaccccgctggtgttcagttacgtcttttacacctgtcaattcatcggcaaacattgctaataattgtttttcaatgccatcttttagggtgacatctaccatcgaacagccattacaccccccgccaaattgtaaaatagccttgccatctttggtaatttcaatcaaggtaatatgcccgccatgtcctgccaattgaggattgatttgcgtttggatagcatattccacacgttcaatcaaaggtgcatcatcagctactttacgcattttagcattaggtgcttttaaggttaattgagaccccatttcttcagttatataatcaatttcagcatcttctaaaaaagggaaactgacttcatctatgaaagcagaaaactcactgtattttatttcatgatctgttgtttctacggcatttttagggcaataagacacaccgcattctgcattaggagagcctggattaacgacaaaaattcggatatttgtaccttcttcttgttgatctaaaagacgacgaaaatgtgcttgtgcagcctctgaaatggtaatttgcataaattaatattcctagcaatacttgagtaaaattatcaggaatgatactcctagaccgctcttttttccagtaatattacttagtttttatgttaagtttttgccagtccccatacatgaataacgttaattcctgcttgttttaatagttttgctatttcatttaatgttgagcctgttgtaataacatcatcaattaaagcgatggaatgatattgttttgctcgcttaatattcacgctaaaagcgttgtgtaaattagatcgtcttgctttttcatttagtcctcgttgcatttttgtgtatttttggcggacaaccagtttattatccagtggaatcgaaagttggcgtgaaagttgtttagcaattaagtacgcttgattataccccctgtaccattgacgaaaatgatgtaacggaacaggaatgatgacttcaggcaaactgaataaatactctcttcttgcatggtaaatcgctaacaacattaattgtgccaaagtgcggtctaaataatagcgattttgaaatttgaattgatgaataagtgtggataaaggtggttgatagcgtccaataactaccatttgttgccaatttggtgattgttttgcacaattcccacaaaacatctgtcctctaaaggcttgattttttgataacacagcaccacaacgtccacaataatttaagcgagaaatttgtttatcacattgataacacaaatgacggtgtgcaaaatttaacggtttttgacaatggacacagctaaaattaaaccagttcacttaagttataacctccagagtggaaaaaagtgcagtattccattcaggaaaatatagatcaaaagattagggataatttctcgatcttaatcacaaaaatgctagaattagccaggctaaactaatcattttatgaaggaaaatttatgtctttaactgactatcgtgaaaaaattagcatggtattttttgatattgacgaaaccttattttcaaaagaaaaagatcatttaccggcaagcacttattttgcattaaaatctttgcgtgaaaaaggtgttttggtaggtattgcgacagggcgtgcacgctgtacttttcctgccaaaatcaatcaaatgattgatgaattagggattgatatttttgttactgccaatggacaacatgttgagtatcaggggcggatattagcccgttatgcaattgacaaaaataaattgtacaaactggttgagttttttgatcaacatggcattgattatgttcaagtagcgaacactgagattaaaatttccagcctcaatccaatactcactgatgcttttaatccaattagtacgaattatcaagtagatcctcgttattttgaacggcatgatgtattacaaattttgtcattctatgaggataaaagctacgatgaattaattgctcaatctaatattttagaagggttaaaaacagtgcgttggcatcctaattcagtggatatatttgataaagacggttcaaaagcacggggaatccaagttgttgttgagcatttaggtttgaatatggaaaatgtgatggcatttggtgatgggcttaatgacatagaaatgctaagtgcggtcggtgttggcgttgctatgggaaatggtcatgaattgttaaaacaacaagcgaattatgttactgatcatattgaagaaaatggcatttataattttttacataaagttggtttggtgtaattttaacaaggttaaataacttataggtcgctttttattttctcggcatcattatcctcagtaagaattcaccgcacttttctattagctatgataaacttattgcccttttaggttgatgatgagtgtttatgaagaaaattttattcattgtattgttgtttttgtgtggtgcaggcggtagcgttttttgggcatattggcaaataactgactttgtaaaacaacctgttaaagtcaaagaagagcaacttttaactgttgtgcgaggaacgaccggcaataaattggcaatattattagaaaatgaagggttaatcgaaaatgggaaatggttgccttggctgcttaaattaaaacccgaattgaataaaattaaagccggtacttattccctcgttaatgtagaaaatattcaagatcttcttgatgtacttaatcagggcaaagaggtgcaatttaatttgcaattgattgaagggcaacgttttaaaacttggcgtaaaattttagaaaatgcaccgcacttgcggcaaacattacaaggaaaatcggagaaagagatttttactttgctggagttaccggcttattcaaaagctgtttatgaatggaaaacgattgatggttggttatatccggatacttatagttacacgcctaactctagcgatttggcactgttaaaacgtgcggcttcccgtaccataaaagcgttggagcgagcttggcaacaaagaaatgtaaatttgccattgaaaaatccctatgaaatgttaattcttgcttctattgtggaaaaggaaacagcattgactgaggagagagcgaaagtagcgggtgtttttgtgaatcgtttaaataagcaaatgaaattacaaacagatccaacggtgatctatggtatgggtgatgattataaaggtaatattcggaaaaaagatttattgacaccaaccccttataatacctatgtgattgatggtttaccgccgacgccgattgctatggtaagcgaggaaagtttacaggctgttgctaaaccggaacagcatgattatttatattttgtcgcagatggaagcggtggacacaagtttagtaaaacattggcagaacataaccgtgctgtgcaagaatatttgcgttggtaccgttctcaatcaaaatagtgaaataaaatgaaaacaggaaagtttattgttattgaaggcttagaaggtgcaggtaaaagcagtactcatcaagttgtggtaaataccttgaaagagtttggtatccacgaagttgtttttactcgagagccgggcggtacgcctttagcagaaaaattacgttatcttattaaacacgaggtagaggaacttgtcacggctaaagcagaattgctcatgttgtatgctgctcgagttcagctcgtagagaatgttataaagccggctttagcaagaggaaaatgggtagtgggagatcgtcatgatttatcttcacaggcttatcaaggaggcggtcgaggtttggatcggcatttgatgacaacgttaaaaaatgctgtgttgggcgattttaagcccgattttacgttgtatcttgatattgaaccggaaattggtttagcaagagcaaaaggaagaggggaattagatcgtattgaacaacaaaatttagatttttttcaccgcactcgagcaaggtatttacagttagtgcaacaagatcctaatgcagtgctaattaatgcggggcaacctattgagcttgtgcagcaagatattcgtaaagctgtgcaaaaatttattgaagaaaatgtgtaatttatatccttggttacaaccttattatcaacaaattatccaaccttttttacaagagaaagggcatcatgctttgttatttaaagctgaacaaggaataggtatcgagcaattgattgaaaatatcgcaggttggttaatgtgccggcaaaaagatgccctacaatcttgccgacaatgccaaagttgtgcattattcagagcaggaaatcatcctgatttttatcgacttgaatctcttgacaataaggatattggtgtcgagcaagtgcgagaaatgaatgaaaaagttagtcagtttgcaaaacaaggcggaaataaagttgtgtttattcgtcaagctgaacgtttaactgaaagtgcggcgaatgcgttactaaaaacgttggaagagcctagaccgcatacttattttttattacaaatggacttttcggctgggttgttagcgacaatttatagtcgttgtcaagcttgggttattaatacgccaacagagcaacaaggtcttgtatggttgcaacagcagcgtcaggaaaaaatcgcagatttacaaaccgcacttcgtattaattataatcgtccattgctggcattggattgtttggaaaaggggttattagaacaacgaacgacatttttacgtcagttttggttgttttatattcgacgttctcccttggagttattaccgcactttacgaaagaaaatgttttattacaactggactggatgagtgcatttttacatgatgcactcaaagaaaaattaggtgttcggcaaggttggatcagccaagatttagctcgtggcattttgcaatttaatgaaaagcaaaatgtggaagagttgttaaaagcaattcaaattatccaaaaaatgcgtttgaatctaacgcaaatcaatggggttaaccaagagttaattttattagagggattgactcgtttggtaaccgatgtatttgaaaggaaagaataggaaaagaaatgtttattgtggatagtcattgtcatcttgatgccttggattatgaaaacttacatacagatattgccgatgtggtggataaagcaaaacagcgtgatgttaaacatttattggcagtaggggtaactttgaagcgttttgagcaggcttatgcacaattagccttatttaaggaagtttccctcgcttgtggtgttcatcctttggatttggcggaagaaccttttgattatcagcgtttattgaggttggcacaagatgaaaaggtagttgcgataggcgaaaccggattggattattattacagcattgaaaataaagctttgcagcaatctgtttttgcacaacaaatagagattgcaaatcaactgagtaagcccgtgattgtacacactcgatccgcccgagacgataccattgccattttgcgagaaaataatgcacaaaagtgcggtggtgttttacattgttttacagaaaattggggaatggcaaaacaagcacttgatttagggttttatatttcgatttcaggtattattacctttaaaaatgcacaagagttacgtgatgtagtacgtcaagtaccattagagcgtttgttagtggaaacggatagcccttatttagcaccagtcccgtatcgaggtaaacaaaatcagccggcttatacacgtgaagtttgtgaatatgttgcaacattgaagggattatcagcggaagactttgcacaaattactacgcaaaattttgagcgtttatttaagattaatgtacaataaagcaacgatttacagggggagttatttatgagaaaaatatttaaaaaggtagtgttggggttactattcttattccatgtttttttattttctgtggtgcattatgttacgccacattatgatgttaccaaagttaccggtgtagaagtaaagagagttgataaagatggacctattactaaagctaatccggccgacggtccgactcgtgatgtgtattatatttacacgcaaaaaccgaatgaggaaaacgtgatggtgtatcgtaatgaagatacacgttggagttttccattttattttaaattcggttccgccgatttacaggcaaaagcccaaagtttttcagtggatcataagttagtggaaattaagtattatggttggcgtttggttatgtttgatgaattccgtaatgcagtgtcagtcaaagaggtgagtgcggatacagaagcttctcattccattttagcttatgttttttacgcatttttattgattacgttatttttctctatccaatttgtgcgtggttggtttgatagtgaagactaactttttggtttgatatgcttctattctcatcagaagctactttgttaggcattgaatattatgagcttattacaggcaatattagtcattattggcttaattattattagtgcggtcgtttcttccgctgaaatttcgttagccggttcacgtaaattgaaattgcaaatgttagcgaatgagggtgataaacgagctgtgcaagtattaaaattacaagagcaaccgggacgttttatcacagttgtccaaattggactaaacatggtggcaatttttggagggattgtgggtgaaagtgcaattcgcccttttttacaggagattttaagtgcttatacgcaatctttttgggtagaaagtgcggcttcttggctggcttttattattgtcactgtttcttttgttctcttcgctgatttaatgcccaaacgtttagcgatgacaagtccggaaaaagtagcattgtcaacagtaggaataatgtctttttgcattgttatttttaaaccagtggtcttaatttttgatactattgcgaacggaatttttcgcttattgggaatttctaccatgcgggaagagagtatgacgccagcggatattgtcgcaattgtagatgccggtgctgaagcaggtgtattaaaagcacaagagcattatctgattgaaaatatttttgaaatgcaagagcgtacagttacgtcaactatgacgactcgtgaaaatattgtgtttttagaccgctcttttgagcgtgagcaagtcatcaccacaattaaaaataatccacattcaaaactacttatttgtgatcatggcttagataaaattttgggctatgtggaaagtcataatttattaactttatatttgcaagaacaacaagtttctttaaccgagcctagaattttacgaaaggcattatttattcctgatacgctttccttatatgaagtgttggagttgttcaagtcttctggtgaagattttgcggttattgtaaatgaatatgctctcgtagtggggattgtaactttaaatgatgtaatgagtattgtaatgggcgaattagtttctaatgaggaagaacaaattgttcgccgtgatgaaacatcttggttgattgatggtgcaactcccttagaagatgtagcacgggcattggaaattaatgagtttccggatgaagaaaattacgaaaccatagggggatttatgatgtatatgctacgtaaaattccgaaaaagacagatttcgtattatatgatagatataaatttgagattattgataccgagaattttaagattgatcagttgatggtatccttaagaaaggatatttagacaagattcaaaagagagtaaaccacatcttcgctttctttagatattatcagtcaaatgcaattaatgggatttttcttataaaaatagaaggttatgtaaaagagataaaaagcaatccgaagattgcttttttgttccgcttattgagcaagtgcacgttttaattttaggatagtcgccttccctttatcttcatcgacttgtttaagattggctccgccaacaaatgcaccgggtttaatatattggcgaataaaataattttttccgccatctgtcgtaatatcaaggtgattatcactaaactctgattctgttgagagcctatgattacctgggattacacgcttgtaaaaatatgttttgggtgcggattcaccaataagtttgccatcgatataaagattcttcttcaacgcagctccaaatattgaatcacgataaatataaatccctgattcatcctttgatggaagcaaaaactgtttagccaaagcatcattttcaggggtatccatcaccgttctggcacaaccggtaagtcccaaagtgattgccagcaagagagttgaaaaaaatttcatttgatgtctagcccatacgacttagaagtaataacttgcactcaatgacaagctttgtggcttgaagcgaatatcgccttctatattgcggaggaagactttttgatattcaacacccacatcaaatttatccgttacggcatattttacccctacagctgcaccaataccgacaacagagtttccttttatggtgcaactatcacaaattttcttggcattaagatcataaaaatgactatttaaactcactttaagatacggcatgaaattgttactaatgcgatagccttgaagatagccaacactgaaagaaaatttttctttggatagtagttcgttattagaagtgatttttgaaccgccggtacgtaattttacttctgcttgtcccacaaaattactgtcaccaaaattaaagccgtaaccaccgaataaaccaaagcctattttgcctgattttttttgggtttcgctttttgctgttttagaaagcgtacccttataaccatgttttgaatgatgaacttctccacccataaaaaagccagtgaaagtatcttgtgccattgcaccacttgccatgcaagataataataccgttgcagcgatagatatttttttcataaataaatcctcttaataaagattaagttaaatttgaaactattttattgttaagagaaaactaagtcttaagatcttaattttcaaagatatattctacataggtatattatgagcaccatagacaaataagacattattagtctaataagtagaaaaatagtctaaaaagaggaaatgaaaaaattatttacatattgtctgaaagtatttaaacgaaaagagcggtgtaaattttaaaaattcgtaccgctctttttctatatcagttacttaaaaagaatattcatgtttctgcgatgttgcagctggtattttctattaagaattataatttaggttcaccaattggtaatatggttttaccaaaactttcattgataatatcagcggcagcgagatagaacgctaaaagtgcggtcaataaaccaaagtttccacctagttggctaaagttgtgattaccggtaaaatcgcctgcggcaagtaagtagaaggtgatggttaacgctaagaaaatagcctgtaatgcacgagtttttgctaatgtgccgataaacatcatcaatgtgaatgttccccacgccgctaagtaccagcctacaaaagatgatgtgacaccttgtgagaaaaataccttgaataaggcaaaactccaccaaaatgcaccatagctgataaatgcagtaaaaccgaaagtattaccttttttgtattcaaacataccggcgatcatttgggctgtaccaccgaacgcaaatcccatggctaatactaaacctaaattttcaccgctgaacataccgttattgattaaacttaataaccaagttgttaatgcaaatccacataagcccaatggtgccggattcgctaagttatcttttgttgtcgacattatattttgcccttaaattaatttgataaataaaaaaggcgttattatctatgattttattgaataaataaagattggtatgaaaaacgctaggataagaacaatgaaattgggaaagtagctagaaaattaattattttttgtttttcgctattgttatttagatgtaaaatacgttcagctgagttttaagggtaaaatacgatgagcgtttagtcgccacttagtctgcaaaatgcgaaatgttaaatcacaagcatgtgagtttaaggattggcaagaaatgttatcatcaagttaaacgtcagtttctcgtttttacgcctaaagttgctggagcacatcattggacacaggtaagctcgacattagaggggagttagaataaaatggatttcgttttctaacagaagaaagtaattgtttttaaaaggaaaatttgttgaatactcaatctaagcaaaacgctagttttgtttttattttaaccttaggcattttatcaatgttacctccacttggagtggatatgtatttgccggcatttttaaatattgcacaagatttgaaagtaagcccagagcaagtgcaacatactttgactttttttacttatggtttggcagcggggcaattattttggggacctgtgggagatagttacggacgtaaaccggttattttattaggtgtgattgttgcgactattacagcatttattttaaccggtattaataatattcaaaatttcaccgcacttcgttttattcaaggcttttttggtgcggcacctgtggttttatccggtgcactattacgagatttgtttagcaaaaatgagctttctcgaatgctatcgatgattactttagtgtttatgattgctccattactcgctccaattattggcggtaatttgatgcgttttttccattggcatgcaattttttatgttatctcggcaatgggaatgctaagtgcggtattggttttttatgttattccggaaactcataaaaaagaaaatcgcattcctctcagattgaatattatcgcacgtaactttttttctctgtggaaacagaaagaagtactgggttatatgtttatgtctgcttttggttttggcgggttatttgcttttgtgacagcaggttcaatcgtttatatcggactttatggtatagccgttgaaaattttggttatttctttatgttaaatattggggttatgattattgcctcctttatgaatgggcgattggtgtttaaagtgggtgctgaacgtatgctacaggttggtttgatggtgcaatttatcgccggtctttggttagcattcgttgcgttttttgatttaggtttttggtctatggcaattggtgttgctttttttgtagggcaaaatccattaatcagttcgaatgctatgacatctattttagagaaatttccaactatggcaggaacatcaaattctatggttggaagtgtgcgtttcggtatgggggcaattgtggggacaattgttgctttatttgaaatgaaaacggcagcaccaatgcttttaacaatgacgatttgttctttgcttgcggtaagttgctattattttttaacttaccgtcatttaaaaaaataaaggaagatcatggcattgcaaccttgccctgagtgtcggcgtaaaatcagtgagtgtgcgataagttgtccacattgcggtttttcgttacaagaagaaaatttgatgctatatcgtgaaaaactaaaaaaacattgtcagtataatcaggagattaaccgagcaagtattaaaatccatttattttggttggcggtgttttctatagtgatcgggattgtcggttggttaagtaattagtcgttaaaagatattcaagcccctgtaataaggggcttttttgtatggtttaactttttgttttcattgctggaaataaaattacatcacgaattgagttagcgttggcaaataacatcgctagacgatcaattcctaaaccctcaccagccgttggtggcaatccatgctcaagtgcggtaacaaaatcttcatctttaaacatagcttcatcgtcaccagcttcttttgctgcaacctgtgcatcaaaacgctcattttgatcttctgcatcatttaattctgagaaaccgttaccgatctcacgtcctccgataaataattcaaagcggtctgttacgtcaggattttcatcattgcggcgtgctaaaggggagatttctgccggatgagccattaagaaagttggttgaattaaatgatgttcagcaacttcttcaaaaattgcattgactaagctacctagcccccatgatttttgtacttcgatacccaatttttgtgctactgcaacagcacgatcgaaatcgtataaatcttctttcacaataccttgctcggcaccgtattttaagattgcctcgtgcatggtaatacgttcaaacggtttgccgaaatcgaattttaaatcgccgtaaggaacaatggtcgtacctaaaatatccagtgctaatttgcgtaaaagttcttctgtattgtccattaaatcgtggtaatccgcataggcttggtagtattccaacatagtaaattcagggttatggcgaatagaaacaccttcattgcggaagttacgatttaactcgaatacacgttcaaaaccgccaactaccaaacgttttaaataaagttcaggtgcaatacgtaaatacatatccacatctaacgcattgtgatgagtaataaatggacgtgcagatgcaccgccaggaataatttgtaacataggggtttctacttccataaatcccttggaaatgaaatattcacgaatgcctgcgattactttagatcgaataataaaagtgcggcgtgaatcttcattagcaattaaatctaagtagcgttgacggtaacgagtttcttgatcgctcagtccatgaaatttattaggaagcgggcgtaatgctttagttaataagtgaacttccgttgcacgtattgtcaactcattggttttagttttaaataaagtaccttttacaccaacaatatcccctaaatcccaattgcccacatcatcagtataaacaccttcagctaggttatcacgagcaacataaagttgaatttttccgctcatgtcttgcaatgtgataaaggttgctttacccatgacacgacgagtcataatacgccccgccacttttacttcaattccctgtgtttttaagctctcactttcaatttcatcatattgtgtatgtaagtcctgtgctaaagcattgcgacggaatgtatttggaaaggcgttgccttttgctcttaacgcagctaatttttcacgacgaaccaacatttcgccattgagatccaattcttgaattatttctgtcattatgtactcctcttggaaagtcacttgtagaataaatttgtcatttgaataaaatattgtggtttttgaccgctctttatagtccggcttttaagctggcttcaataaaacgatccaaatcgccgtccaatacagcttgagtattgcgattttcaacacctgttcgcaaatctttaatacgggaatcatccagcacataggagcggatttgactaccccagccgatatcagatttactgtcttccatggcttgtttatcagcattttttttcatcatttccatttcgtacagttttgcttttagctgcttcatggcttgatctttattctgatgttgagatcgtccattttggcattgcaccacaataccgctaggaatatgagtaatacgcaccgcactttctgttttattaacgtgttgtccgccggcacctgatgcacgataaacatcaatacgtaaatccgcagggttgatttctatttcaatatcatcgtcaatttcaggataaacgaaagcggcggcgaaagaagtatggcgacgattattggaatcaaatggacttttacgtactaaccggtgaatacctgtttctgttcttaaccaaccgaaagcatattcgcctgcaatacgaatagtggcagatttcaagcctgcaacatcgccactggaaacttcaactaattcggttttaaagcccttgctttctgcccaacgtaaatacatacgcaatagcatttctgtccaatcctgagcttctgttccgccggagcctgcttgtaggtcaacataacaatcacagttatcatgttgtccgctgaacatacgacggaactcaagggcggcaagttttttttccaattcttccgcttctgcgacagcttcattaaacgttgtttcatcttccgcttctacagaaagttccaataagccatcaacatcttccagaccctgctcaagggcttttattgtattaacaacaagctctaaattagaccgctctttgcctaatgcttgagctttttccggttcattccaaatatccggttgttcaagttctgcatttacttcttctaaacgttcaacttttgtatcaaagtcaaagataccccctaagcatatttgtacgctcagtgagatcgattaatttattttttatcggattaatttcaaacatagcttttcccaatgataacaagtgctgaattataagctattttgctgatgttgggtagttgcagattagattgttcaaaggatttatgttagaatttcgtccgttttttactgaaaattaggaacttaaaatgaaaaaatttttaatggtaagtttagccatgttgatgtcaacttttgtaaaggcagataataatgtcacaattcgcaaaaatttacaaaaattaggtatgactgatgtagaaattatggagtctcccattaaaaatataaagagtgttttgacccgtgaaggtactctgtatgtttcggaagatggtaaatatgttttacatggtgctttgtatgaaattactgacaaaggtattgtgaatttaacgacaaagtctttattggtaaaactgaataacttaaaaaatgagatgatagtttatccagcgaagaaggaaaaatatgttattaccgtattcatggacattacttgccattattgtcatttattacatcaaaaaattaaagaatataatgagttaggtattactgttcgttatttagcttttccacgtgccggtctaaatagcaatacagcaaaacaaatggaggcgatttggacatctcgagatcctgttttcgctttagatgaggcagaaaagggcaatttaccgaaagagctgaaaattccaaatatgattcagaaacattatgagcttggtattcaatttggagttagtggcacaccaagtattataactgaaagcggcgaagtgattggcggttatgtagagcctaaaaaattattgcaagtattagaagatattcgtgaataagtttattaaacgacgtgatgttgcgatagatgttcaagtttgtgagcatcctttattggaccgaatttaccgtgcacgtcaaattaaaaatcctcaacaattagaccgcactttgaaatctatgttggcacctgatttgctacatggtattggaagtgcggtggatttattggtaacagcgagagaaaaacaacaaaagattgttattgtcggtgattttgatgttgacggagcaaccagcacagcactcattgttttggctctgcgtcaacttgggttcacagatgtagattatttagtacctaatcgctttgaacaaggttacggtttaagcgtggaagtagctaagttagcattagaaaaaaatgttgagttattgattacagtagataatggggtatcttcttttgatggtgttgtgtttttaaaaaatgcgggagtgcaagtgttgattacagatcaccacttaccgccggaaatattgcctcctgcccatgctattgttaatccaaatcttacacaatgtaattttccttcaaaatttcttgctggtgtcggtgtcgctttttatgtcatgctggcattgcgtgcaaaattacgtgatttagggatttttactacgcaaacccaaccgaattttacagagttattagatttagttgcccttggtacaatttccgatgtggtaccgcttgatcaaaataatcgtattttagcttatcaaggtttagccagaattcgagctgagcgttgtcgtcccggtattcgtgctttggcggaaattgcaaatcgtaatatgagtcgattgaccgcttccgatttaggcttttctattggtccaagattgaatgctgccgggcgtttggacaatatgtctgttggtgtggagttattattggccgatgatatgcaacatgctcgtcaattagcttttgaattagatagtttgaatcaggctcgtaaagaaattgagcaaggtatgaaacaggaagcgttagaaatttgtcggaatttgaccgcactttctaagcaattaccgctgggcatcgtactatatcaggttgattggcatcaaggtgtacttggtattttggcttctcgaattaaagataaatttcatcgaccgaccattgcgtttgctcaggatcaagtcggaattttaaaaggttcagcacgatctattgaaggtttacatatgcgtgatgtgttagagcgtattcattctcgctatccggatatgattttaaaatttggtggtcatgcgatggctgctggtttgagtattcgtgaggaattgtttacacaatttcaacaagcctttattcaaactgtgactgaatggttaaaagaagaacaattacaaggtattatttggactgatggtcaattagcacccgcgtttttaaatttggagacagcggaattactgcgtcaagcaggtccttgggggcaaggttttccagagccgtgttttgatggtgaatttacaattttacgccagagtattgtgggtgaaaaacatttaaaaatgcttgttgagcctaaacaaggaggtccgctgttggatgctattgcatttaatattgataaggattactaccctgatttttcgataaaacatgcaagaatagcttataaattagatagtaatgagtttcgtggaaatcgtcatgttcagttgttggtagattatattgaacctttagatcattaaatttatttttcggcactggtacataataatgttttagggacaataaaaatgacagaagaatatggcgtatttacttatccctatgtcattattaatggtaaatatgttttgacagcaagtactttatataacgatgattatagtgttgcagtgcttgattttttaattcatcaaattcaagtggagagcaggaaatgaaagtaggtattgttggtgcgatggcacaagaagttgagattttagcgagtttaattgagaataaaaacgtagttcatattgccggctgtacaatttatcaaggaaacattcaagataaggaggttgccttattacaatccggtattggaaaagttgcagcggcaatgggaactacactattattgcaaatgtttaaccctgatattgttattaatacaggatctgccggcggcgtatcctccggattaaaagtgggtgatgttgttgtgtctactcaaactgtttatcatgatgctgatgtgacagcctttggctatgctaaaggtcaactgcctgcttgtcctccagcttttatttctgatccaaaactgaccgcacttgttgcaaatgttgcaaagcaacaaggcattaatctgacttccggtttaatttgctccggtgacagttttattaatagtgcagaaaaattagcttggataaaagcaaattttccagaagttgttgctattgaaatggaggcaacagctatttctcaggtatgtcataaattcaatattccgtttgttgtcatacgggcgatttctgatgtcggagacggtgaagcaagcatatcttttgaagagtttttgcctttagcggctagacagtcttcctctatggttctaaagatattacaaagtttgtagggaattgatttattataaatatcaacttgataaataaagaaaaaatctccaaatnnatctgcaccccaaaagttggactaaaccgttaacaagttaaggcacagattttttatgactaaatataatcaatcttttaaccaacaagtgattgaattttatcttcaaaacgggaaaaatcgctcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagattttttgttttggattattttgagcttggaatgctgaaacgcttgttgaaacgttctacacgaccgccggtatcaacaacacgttgtttaccagtatagaaaggatggcagttgctacatacgtccaagttcaaatttttacccactgttgaacgagttttaattacgttaccgcaagaacacgtcgcagtaatttctttatattcagggtgaataccttgtttcatagaaaacctcttaaaaatcactccgctctccaaaaccgaatttggcaccgagtgctgttaatattacgccatctaaaggcaatttagtaagatggcagattataccgaaaaaatgggctttttcaagttatctgtataaaaaaccgcactttatccttgcatgttaaagtgcggtataatttgcaacaattttttacattgctgtccaaagtaaaatggcaagcaactgaggcgacataatacgcaggaacatagaaagcggataaacagtagcgtaagataatgcagctataccgctatcttctttaattgcattggcaaaagctagtgcgggaggatcagtcattgaacctgcaagcaaaccgcataagctgagatagtttaatttcatgtataagcgagcaataatgccggtgatcattaatggaataaaggtaatgaacataccatatcccatccattcaaggccttgaccattaaccagtgtgtcaacaaatccgcctccggattttagtccaacaacagctaggaataaaacgataccgatttcacgtagtgctaagtttgcactgggcggcataaaccaatagagtttaccgacactaccaatacgagcaaggattagtgcgacaactaatggacctccggctaaccctaattttaatgctacagggaatcctggaatgtagaatggaattgagcctaatagcacgcctaatccaattccgataaataccggtaacatttgaacttgttgtagtttttgttgtgcattgccaataattgaggttgcattaccaattgtatcggatcgccctacaatatgtagcacatcgccaaattgtaatgcggtgttggctgttggaactaactctacgccggcacgatttaaacgtgaaatcacaacgccatattttttatgaattcctaagtgttttatgcgtttaccaagcactttttcattggtaacaacaatacgttcagagcgaagatctcctgctaaatgagtcataggcatatcaatttcctcacctatcactaatttcatttttttcaaggcattgatttcaccaactaaatgtaatacgtcatcaattgctattatggtatctgcacttggtacactaatattttcttgtcgttttaaacgagaacaaaccacatctttattgtcaaagccgggaatatcaattaatcgtaaaccacttaaatttggattggtcactttaacatttactgttgttaagctttctttatcctgtccgctggctttttggaattgtttctcttcttcttcaaccttaattttaaaaaataaacgaattaaccacatgctaagtaaaatgccgcaaatcccgaaaggataagccatagcgtacgccatacccattgtgctgttagcattttctatgcccagttcagtgagaatttgttgacccgcacccaaggatggcgtattagtgaccgcaccggagtagataccgagaataatatcaagatcaacattaacaactttatataggacaaaaacacttactgcaccgagaacaacaattaatgttgctaagccgttaagttttaaaccagcagaaagtagagaggcgaaaaatcccggaccgacttgaatgccaatggtataaacaaatagaattaacccaaattcttggataaagtgtagagtgtgtgcatctaatttcaatccattttggttcataaaatgagcgacaataatcccaccgaataatactcccccgatgcctaaaccgactccgcgtattttccaatgccctatccataaaccaataacggcaacaagggctaggatacaaattgtgatagcaatatcactcataccgacctcttttaaagttaaatataaaaaatagctactcgaattatatcaagctcaattcaaagaaacgataaaaatctaaaaaatgtaggatttatcacatttttcttgattaagttatggtttttattaacaatatttgaaaaaaattaaatttcatttaatccctttattataagaggcgttgagaatacaaaatgaattggacggaagaactttttacatcgttactttggatagtgaaaagcttatttatagcaagcttggttttctctttaattttatattttttgataaaaatgacccgatggggacatcaattttggctattagcgaaaagttatttatcaccacgtcatagccttatgcctttgtgttatttttgggtaatcgttttttttgacttattatccgtgcgtttggacattttattttccagttggtacaagtccatgtatgatgccttacaagaaatgaacgtagttggattctggcagcaaatggttgttttttcccttttggctatggttcatatatttaatgttttgcttacttactatatttctcaggatttcaaaattaagtggagaacttggcttaataatgaaatgttagataaatggtctgaaaatcaggcttactataaaacccagtgccttgctcatcaattggataatccggatcaacgtattcaacaagatgttgatgcctatgtttctaattcattaaactttgctacaggtgttatttcttctacagtgtctttagctgcatttaccgtgattttatggaatttgtcaggtccgatggtaattatgggctatgaaattccacatatgatggtattcttggtttttatttatgtattagtgagtagtgtaattgcttttagaattgggcggccattgattcaattgaattttgttaatgagcgtttaaatgcaaactatcgttattcattaattcgtttaaaagaatacgcagaaagcatagctttttatcgaggggaaaatatagaaaaatcgatgttattacgccaatttgaaaaagtaattggtaatttgtggcaaataattcaccgcactttgaaattatctggcttcaatttagtggtttcacaggtatcagtcatttttccatttattattcaggcagcccgttatttttccggacagattaaattaggtgatttaattcagacgtcacaggcttttagcaaggttcagtcagcattatcgttttatcgaaactcctatgatgattttgctgcctatcgagcggttctggatcgtctaacaggtttccatagtgctattgaagcagctaatcagccatcaaaaacacaaattaaacctcatatgtcagcggttatttttgagaatttaaatattaatacaccggaaggaaatactctcattgagaagctgaacttaacaattgagcaaggggtttctttattgattaaaggtaaatcgggtgtagggaaaacaactttattgcgtacaacagcaggtttatggccgtattcagaagggcagattttttgtccacaacaaacattgtttctagcacaaaaaacctatttaccacaggggtgcttaattgatgctctttattatcctgaaccggttccggccgacattgacgcagacaatatcagtaacattttgcaaaaagtgcatttgtctcatctggttgacaaattggatgtagaaaatgattggacgagagtactatctttaggggaacagcaacgtgtagcttgtgccagagtattgttgcataagcctaaagttgttttcttagatgaggctacatcaagcatggatgaagggcttgaagatgcgatgtatcgcttattattaactgaattacctagtacaactttaatcagcgtgggacatcgttcaactttgcataagtatcatcaattacacttgcagatcaatagtgataaaagttgggacatgatgaaacatacagaaacattttagcgtaaaacatatttgttaatttgctgaatgaaatgtatccattgatgttaagtcgatggatttttttacgttctaaatttgacatagatcaaataaactttatttttatttgcaaagcattctcaataaaaatgagtttttttactagaaaaatgaatgattaagcaggtttttcttacaaaatttatgcaaataacacacaatatatagtggttgagtttttaaaagtaacaatatatagtgatttgacttttcttaaacgcaacatataggtttatgtaaaaatgggttcattcttcgttattaaacgtgatggttcacgtgcagaatttgaaatacaaagaattattaatgctattaaaaaagctgcaagtgcggtcaatatccaagatgaaatgttctgtcataaaattggacaactggtctgtgataatatttttgctcactaccaaaaagaaattgatattagccacattcaggagattgttgaaaatcatctgatggctagcaagtatccacaagttgcacgagcttatattgaatatcgtcatgagcgtgatttagctagagagaaacgtagtaatttgactaaagaaatcgaaggattaattgggcaaagtaatgtggaattgttaaatgagaatgccaataaagattcgaaagtcattccaactcagcgtgatttattggcgggtattgtcgctaaacattatgctaaacgttacattctgccaaaagatgtcgttgattcccatgaaaaaggcgaaattcattatcatgatttagattatgcaccattctttcctatgtttaactgcatgctggtcgatttaaaaggtatgctgacgaaaggatttaaaatggggaatgcggacattgagccgccaaaatctattggtactgcgactgcggttaccgcacaaattatcgctcaagtagcaagtcatatttatgggggcaccacggttaatcgtattgatgaagtacttgcaccttatgtgcaactcagctatgaaaaacacttgaaaacagctgcactttggcaaattccagatcccaaagcttatgccgacagtttaattcaaaaagaatgttttgatgcttttcaatcgttggaatatgaagtcaacactctgcatactgccaatggacaaacgccatttgttacttttgggttcggtttggggatcagttggcaagagcggttgattcagaaagctattttgcaaaaccgaattcgtggattggggaaaaatcataaaacacctgtttttcctaagttggtttttacaattaaaaaaggggtcaatcaaaattcaggagatccgaattatgatattaaacagctcgctttagaatgtgcttcaaaacgcatgtatccggatattctcaattatgatcaagttgtgaaagtaacaggttcatttaaagcaccaatgggatgccgtagttttcttggtgcttatgaagaaaataacgaattggtccatgatggacggaataatttgggtgtagttagcctaaatttgccacgtattgcactggaagcgaaaggagatgaacagcaattctatacattgcttgaagcaaggttggatcttgctaaaaaagcattgatgacacgtattgcccgtttggaaaatacaaaagcacgagttgcaccaattttatatatggagggagcttgtggtgttcgtttaaaagcagatgataatgtggcacaaatttttaaaaacggtagagcatcaatttcgcttggttatattggtattcatgaaactattaacgccctatttggcggtaaacacatttatgatgatacaaaattgcgtaaaaagggcattgaaattgtcagtttcttgagcgaaaaagttaaacattggaaagcggaaactggctatgcttttagtttatattccacaccgagcgaaaacttgtgtgatcgtttttgtcgtttagataccaaacagtttggtgttgttgatggggtgacggacaaaggttattacacaaatagctatcatttagatgttgagaaaaaagtaaatccttatgataaattggattttgagatgccttaccctcgtttagcgagcggtggatttatttgctatggtgaatatccaaatattcagcataatttaaaagcacttgaagatgtttgggactattcttatgaacgagttccttattatggtactaatacaccgattgatgaatgctatgaatgtggttttacaggagagtttagttgtacaagcaaagggtttacttgccctaagtgcggtaatcatgatagtgaaaaagtctctgtaacccgtcgagtatgcggttatttaggaagcccggatgcacgtccgtttaatgctggaaaacaagaagaggttaaacgccgtgttaaacatttataaaaatcatcgctctttatgaattatctgcaatattatccgattgatgttgtaaatggcgaaggtacaagatgtactttgtttgtcagtggttgttcccatgcttgcaaagggtgttacaaccaaaagagttggtcatttagggctggagtattatttgatcgagagatggaagatcaaattattcgagatctacaggatagacgcattcgccgacaaggattgagtttaacaggtggtgatcctttacatcctcaaaatattaccgcacttttgccttttgtgcagagagtaaaaaaggaatgtcctgataaagatatttggctatggacaggttatttattagcggagcttgatgaattgcaacggaaaatgttgccttacattgatgtgttaattgatggtaagtttgagcaagaaaaagccgatccaagtttgatttggcgaggatccgccaatcaagtaatttatcgttttaagctttagcttttacacaagtccttgcataagcatactcatacgaatggtgcggtatatttaaactctatattgaatttgtataaccaacgtcaatttagatcgttattacgatatagaatatatcagcaaatcgaatattataaaaaaaccgctcctaaagagcggtttttttgcgaaggttttaaatcgggtagccaagttgtattactacaacttagccccctaagaactgtacaagcaaatttctctgcatacagctcaagcctttctattaactgctacgcagtcggtttcgcaacgttcaaattcaggcgatgaatttgttggtgacactcaggatgtactaaacatctgttatttagtgaatctgttccaccatacattttgtaaattatatgatgatcgtgccagccgctttctttcgttattgacgtattacacaatgcacattttcctttctgctctttgtaaagagcttgccattgctgtctgtgtgattgttcatcatacattctggcttgagcaaggttttctccatacatttcccattcaggtaaaaatggtttgtattgtgattttatctttctgtgtcgcttaattttcacatatccacaatagagtaaatttattgggatttgttcttctttattgctgttggtgactgtgccgaaaatccaattccgagttgcatttgaataaaagtatttctctttaatccaaatttttcctttgtttggatgtcttcgtctgcaccaacgccataaggctttccaaattaaactatccattcggttaaatatcactttagccacaacgtgtttatgatagtttgtccaacctcttatcattggatttaatacttttattaggtcatcttgtttcgccattttcatttttgaaattgattgttttaccttgtcgtaaaatgcttttgcatttttcttacttggtttaataatcaattttttatcaaaacgtttaacagtccaacctaaaaagtcaaatccgtgttcgatatgcactaccttggttttactttccgataaggaaagccctctttctgcaagaaagtttttcaccatagggataacttgttcttccagtaattcttttgatatacctgaaataataaagtcatctgcatacctaacgaggtatgtccgatgttttgctattttaagactattctttgcaccaaagtgcttgattagctctttttctaacccatctaacgccatatttgccaacgttggagagataataccaccttgcggtgtcccctccgttgttggttttagttgaccgaactcaacaacacctgattttaaccatttcttgagtattcgcttattcattggaatatgcttgagtagacagtcgtggttaataaaatcaaaacaaccatgtatatctgcatccagtacccattctgccatttgacgagattggtttccttttgttgaaaatatactatgtatatgtgatatagcatctgccgttgaacggtttaatctaaatccatacgaattattgtctgctgttgtttctgctatgggttgcaatgctagtaaatacaacatttgcattgctctatctttcatcgtgggtatgcctaatggacgtttcttcccatttgactttggaatgaaaacccgtcttaatggtttaggttgataccctttacttgatagatcttgtatagcaatccatttggattcaggtgtatcccaaatccgtttatcaataccagcggttcgtttgcctgtattttccgtcacccgtcgtactgctaatgcttttgcataaaacgagtgggtaagcattcgttgtaagtttttaaccttacgccaattgctttcctgtgttgccttcgcaatccgcacctgcattcctttcacatatcggtttgctttataccaattgatataatgccattgcgatatatgtgaggtcgctggagctagactgcttactaatttcttagtatgatgagtttgctctttcatacttacctccgttgagagataagttttcttggtaaattaatcgttcctctttctgtttggacacttcaagagttgctatggttaccaataaacttacactcttgaatcactaaggataaagagtgcgtgcgttggttttatttgattggttttcaatctgcaagccaacgctcgcttttatcccgtcaaattttaaaggaatttgtcagacatcttgcgatgaaagaccggttagaagtctgcaccctttcgggttaggtcatatttcataccctatttgcaccattacagtacaaccttcgctttctctaacttcttttacctacaccaccaacagcattgcttacgcgttgcctgccatttttcaggcggagatataggcttaccaagttccattattactacatggatagggaagatatagtcttttttcccgacagtgtttatgatgacgtatcccaaggctaaaatgagataacccactgcataccttttggttcaagccgatagcgaccgtaggcttgttctacataacgagaattacgactattcacttacgtttatctttctatccaacctagtccctcaacccaatggtcgtttcgagtctcttattaatacttcacagtattaataaccttatcgggggtacattgtcaggaagctccgcacaaaatcgttgccaattatgcactatccctaggttactgttagtcatataacaggttacactcatttatttcttcgcaactgcatatatcaacgttgaaacaaattgtaacaatagtaataacagcttactcatacttaactaagttgttacctaatacagcaataaataagcccttgctggtttgctttaaaacttactttatccattaaacaaatgtttaatagtactttratagtactttgtttacgtttaatcctctaataggaaataactaacctttaacaaataaaaactcatttgttagtaatgattatttcaatgaaaggggatttgggtaaattttagaccgagaagtagcagtgctgttccgcaagccattcacgggcaactattactttcaagttgctgagggtgtttcttaataaaagaatatcccgaagtacagtaaataaagataagtgtaaaggtggcaaccaaatagaagaaattccactttcttatactcgaaccgtttcagattgctacggtatctttcggactttatttatagtaggggtgaataatcattctttatggacgatatgacgttttggatttgacccaagtcactctataaataggcgactaacggtagtcctatctttcgataacggatcttgcttgcttactcctcttaatatttatctaaatattaagtacataaaagtgaagaccataccttattaccgcataaagttggagatattcttaccaacttagaactagatcttgagcaacgctccttttctagtctgctacccaaactcttcccgagaagatctggatagtcaagagaaagctacattacatagctttctcttaattgagttaaatccttgatatataaggacttaaccccagtaagcacaacacttgtcgcacttagcctttgtagttatgtacatgagcaactaaatctaatactttatttgagtagccagtttcattatcataccaagaaactaatttaacgaaagtatcagttaatgcaatacctgctgccgcatcgaatacagaagtcaagctacaaccgttgaaatcagtagaaactacagcgtcttcagtataacctaatacacctttcatttcattttcagaagcacgtttgatttctgcacagatttctgcataagttgccggtttttccaagtttacagttaaatcaacgacggaaacgtttggtgtaggaacacggaatgccatacctgttaatttaccattcaatgcagggataactttaccaacagcttttgccgcacctgttgaagaagggataatattttgtgccgcaccacgacctccacgccagtcttttgcagaagggccatcaacagttttttgggttgctgttgttgcatgaactgttgtcattaaaccgtctttgataccgaatttgtcattgataactttagctaacggtgctaaacagtttgttgtacaagaagcattagaaacaatgtcttgaccggcatacgcatcaaagtttacgccgttaacaaacattggcgttgcatctttagatggaccggttaaaacaacttttttcgtacctgcggtaatatgtttacgagcagttgcgtcatctaagaataaacctgtcgcttcaacagcaacatcaacaccgagctcattccattttaaattagcagggtcacgctctgatgtaacacgaatcgctttaccattaaccactaagtttccatctttgacttcaactgtaccatcaaaacgaccatgagttgaatcatatttaagcatataagccatatattcaacatcaattagatcgttaataccaactacctcaatgtcatcacgagtttgtgctgcacgaaatacgatacgaccgatacgaccgaaaccattaataccaattttaattgtcataatattttcacctataatattttaagttaaacgaaactcgatgctttacagaagtgcttagtctttctagttttcaggctggggtagattatagcataaattcttctttgattatagtgtctctagagtaaatccggcatatatagattttttatgatccacgtcaaagttgataatgtttgtaccacattgattttttagtgtagtatgtgcggagatttatgtttcatcgttacgcggaaaatgacttttcatatggaaataggaagaatatcatgttaaccaaccaaccaaccaaccaaccaaccaaccaaccaaccaaccaaccaaccaaccaaccaaccaaccaaccaaccaaccaaccaaccaaccaaccaaccaaatgaacgtttattttccatagtaaaggaagtttttccgaaaagtcatagcataaatttttctcttttaggaggaatgaccaacaagaattatctcctttatgttgataatgaaaaatatgtattgcgtctgccaggggtaatgacatcgaatttgatttcaaggcactatgaaatgaataatagtatattgatgtctcaggcagaatttaatgttgaaacaatttattttaatgctgataatggtattaaaataacgaagtttttagaaaaaggtatcaattttaatcataataatattcatcaatatgaatatttatttctcatctcaaaagaattatataaattacatcattcagatattcaatttaataatgaatttaatgtatttgaaacttttcaacaatattttgacttattaaaagataagaatggatttttctgctttaataaaaatattccattgatatacgaattttttattaaaatttcaaagaataattctttttataacatcaaatgtccttgccataatgatcttgttcctgagaatattttaatgaaaaacaataaattattttttattgattgggaatattcaggaatgaatgctccgttatttgatgtagcggctttttttcttgagtcgagaataccagaagaaaaacaaaaatatttccttgttcattatgatcatcatctggattttgaaaagtctcgtatggaaatactatttcatcaatttacccaagatgttttatggtttttatggactttgataaaagaagaaaataatgagaaatttgaaaattatgcctcaacaagaataaatcgtgcttatgaactgatgaaggagttggtgaaaaatgggtttatttagtgaagataaacgattagttcatgtcggttatttttgtggattattatccggtttattttgggcaatatcaggaatttcttacgaaaaattatatctagatttcccaatgctgaatgcgtttgcattaaatattattatattaagtattgctgagattactttgctgttaatggcttatggttatttgataaaaagaaaattattaccgcactttaataaggtttctttgttagcgattttgggaggttgtttgggtggtcctgttgggatgatttgctatttacagtccttacaatatgttggagtgagttatgcggcgacgatttcaatttgttatccaattatagcatctattttatccatcaagtttttagctgtgaaagcatcaagaagaacactattttcttttgtttttattgtcttattattaatgcctatcatgtatcaaggtgaaaattcagaaatcaggattttaggcattatttttgctttttcttgtgcattatgttgggcacttgaaattgtgatttccagttatgtcatgcaacactatccatccgatcaagtttatttatttagacaaataggatcgtctttaggatattttcttattattcttttcatgtttttttatggaacttatgacaatttaattgattttaatttttttaaggatgtaaatctatggaaattggagtggatagttattatttcctcaggattttcttattttctatattataaatcaattgcaattttgaatccaattagagcaatggcattaaatattacatatagtctttgggcgattgtattaagtgcggttcttttatcaaaggaaattagtatctttctgcttatgattggaataattgtattgatgaatatttttattgtggcgaaaggagaagaaaaatgaatgccattattttagctgcagggttaggaagtcgttttagagagattacgcagaagaagcataaggctttacttccgttacctaatggaattcctaatattgagcaaacaattatttatttaaagcaagcaggtattcatgaaattcatattgtaacaggttattttgctgagcagtttgattttttaagcagtaaatacggggttaatcttatttataataatttttataaaaattacaataatatctattctttttattgtgctattgattatttcggagaaagttttgttattgatagcgatgtgacactttttagcaatatttttaatgatacattaaaacgaagtcaatattttttgattcaaaggaataaaagtcataataaagaatggattccgattgtgaaagataataaagttattgatattattattgacagtttggagttgccgagtttactgggtgtctctttttggtcaaatcatgatgcggtcaaaataaaatcatttctggctgattatgtgaataatgaaaatttattacttgattcatcattgtattgggataatattccaatggaaaatcttaaagaattggatattggtgtaaagcttttgaatataaaggaagcttatgaaatagataatttatccgagtatgactttatatttcatcatttaaaaggtaaatagtatgaaaaaattatcattgagagaacttcaattggcatcattagatattttgaaatattttgatcaattatgtgctaaaaatgatattcaatattccttaggtggaggtacattaataggcgcggtaagacataaaggatttattccatgggatgatgatattgatgtctatatgcagcgtgatcagtatgaaaaattcgttaatgtttggaaaagtgagacgcatgctcaatatgaattgtctttagcggaggatattcatggtatgtttccgggtgagatgacaaaaatttttgataaaaatactgtacttatagatacgaaaggaagaaaaagtggcatatttatagatatttttatttatgatggtgtgccaaatgacccggcggtgatttataaagtgatgaagaaacatcgtcgccttaaattgaggttttcatcttgtcgtaagagatggtataaagctaataatgagagtttaattcagtctatattttttagattatcccagtatttatttaataagatgatgttaaatttaaaacaatttcaagacaaatatcctattgataaggctgaatatataggacttgttttatcagattacggtggctggaagaagtcttatatgcctaaaaaatattttaactccgttgtttatttggattttgaagagagtaagtttcctgttatgaacggttatcatgaacatttgaccatgtattatggtgattatatggaactgcctcctgttagtgaacagaaacctcaacacacgattgaagcttatatattagattaggcaatctatttcttttttattaaaaatcagcaaaagagcggtcattttgctgatttttttttgatttatcggcataataggtgctataaaaattttatgggagtcattatgtgtaggggaaatttatatattatttctgccccaagtggagcagggaaatcttctttgatttcagcattattggaacgggataaaaacgatagtatgacggtgtccatatcacatacaacaagatccccaagaccgggtgaaattgatggggtgcattatcactttgtttcacatgaaaaatttgaacagcttattttcgaaaactcatttttagaatatgcgaaagtattcggtgggaattattatggtacgtcattactgaatattgagaaaaatttagcggcaggtatagatgtattcttggatattgattggcagggggcaagacaaattcgagaaaaacgtcctgatgttaaaagtatttttattttgcctccttctatttctgctttagagaagcgtttgattgggcgtggtcaagatagtcaagacattattgcaaagagaatggaaaaggcagcggatgaaatctcccattatgatgaatatgattatgtcattattaatgctgattttgatcaagcattagtagatttagaacatattttgcgagctgaacgattgactgtaaattatcaaaaaacgcaaaatgcggctttaattcatcaattactagtaaaataattttggttttagtatcatgggagcgttttttgtgaatacattaatggagaaattatggctcgagtaacagtacaagatgcggtagaaaaagtaggtaatcgttttgatttaattttaactgcggctcgccgtgcgagagaattgcaattacataagcgtgaacctttagtgccggaagataatgataaaccgacagtcattgcgttgcgtgaaattgagaaaggattaattaataacgatattatgaacgctcatgagcgtcgtgaggcattagaacaagaaactgctgaattgaatacaatatcgctgttatatcaaaataattaagtaaagtgcggttcttttttgtaaactttatcaagtacatttcaatcttttttgcatattaatcaatagtcaggtgtcttttgtatttatttgagagtttagagaaaattatcagaggatatttgtctccgtcacaaattgagttagttcggcatgcttttgttattgcaagagatgctcacgaaggacaagcgagggctagtggcgaaccttatattactcatccggttgccgttgcttctattattgcagaaatgcatttggatcatgaagcagtggttgcagcgttattgcatgatgtaattgaggatacgccttatactgaagagcaattaaaagaagagtttggtgcgagtgttgctgaaattgtggagggtgtttcgaaattagataaattgaaatttcgtacacgtaaagaagcggaagtagagaattttcgcaaaatgattttggcaatgacaaaggatattcgtgttgtgttgattaagctagccgaccgtactcataatatgcgtacactgggtgctttaagaccggagaaacgccgtcggattgcgaaagaaaccctagaaatttatgctcctttagctcatcgtttagggatagagcacattaaaaatgaattagaagatttaggttttgaagcaatgtaccctcaacgttatgcggtattgcgaaaagtgattcaaattgctcgtggtaatcgtaaggatatgattgagtgtatcgcttcagatattaaaggacgcttgacggaggctggcattacggcacgagtatttggtcgtgaaaaacatctttatgctatttaccaaaaaatgcgattgaaagatcagcagtttcattccattatggatatttatgctttccggacggtggtaaaggatgtggatacttgctatcgagtacttggtcaaatgcacagtttgtataagccgcgtccgggacgggtgaaggactatattgctgtacctaaagccaatggttatcaatctttgcatacatctatgattggaccacacggtgtacctgtcgaagtacaaattcgtacggaagaaatggatcgtatggctgaaatgggtgtggcagcacattgggcatataagcaatcaggacgaaatgacagcacaacggcacaaattcgagctcagcgttggttgcgaagtcttgtggaattacagcaaagtgttggtaattcttttgagtttattgaaagcgtaaaatcagagttctttcctaaagaaatctatgtatttacccctaaaggacgtattattgagttgcctaaaggtgcaactgcggtcgatttcgcttatgcggtacatacagatgttggacatcattgcgtggcagctactgttgatcgtaaaccttatccgctttcctttgcattacaatcaggtcaaacgattgatattagtatcgatgaaaattcaaaaccaaattcggggtggctaaattttgttgtgacagcgaaagctcgaacaagtattcgccaagcattgaaatcgttaggtgctgatgatgctgttaatttaggcaaacgccaattactgcaggcacttttacctaaaaaacttagtgatattccaccgcacattgtgcaagaagttttagatgatttgaaattaacgagttttaatgacttgctgatggaaattggtttaggaaatcagattagtggagcaattgcttatcgattggtgggtgagccattgaaaattgatacggatggtaatcctaaaaataatacggaattattgcaaattaagagctctgaaggtttatcaacaacctttgggcaatgttgtcatcctattccgagagatccaattgtggcttatacgagttcagggaaagggcttgttattcatcataaggattgtgctaatttgaaaaaacgtaaagagaatactgaacattatatgcaggtacaatgggaggatgaagatacctcgattgagtttgaaactgagttgcgtattgaattactgaaccaacagggtgctttacctcatttaatgtcaatgatttcttctttggatagccgcattcatagcatttggacggaagagcaagacggtcgcctttaccaaattgttattttattaaccgtgaagaacacagaacatttggagcaaattatgcgtaagattaaaagtgttcctggctttttatctgtcaaacgcaacattaataattaatgggtggacaattcttagacgctattccacttacttctttgtcgggtgtcggtgccgcaatagcagaaaaattaggtagaattgggctttttagcctgcaagatcttctgtttcatttgcctattcgttatgaagatcgtacccgtattacccctattattgatcttcgtattgatcaacatgcgacaattgaaggaatagtacaaacttgtgatattcaatttggtcgtcgtccagttcttgtggtgacgctttctgacggtactgccaaaattgccttacgcttttttaattttaatgcaggtatgaaaaatggctttcagcttggagcgagggtgaaagcctttggggaaattaagcgtggtcgatttatggctgaaattcatcaccctgagtatgaaattattcgtgataatagacctcttcagttagcagaaacgctcaccccaatttatgcgacaacggaaggcttgaagcaaaatacattacgaaagttgactgagcaggcattagtgttgctagaaaaaatgccattagcggaattattgcctagagcttttaatcctcatgattttagtttaaaacaggccatttacgttttacatcgcccaccacccaatatttctttggaattgttggagcaaggaaaacaccctgcacagttacgtttaatttttgaagaattattagcacataatcttgctatgcaaaaagtgcggtgcggatctcaacatttttcagctttacccttacgttatcaaacagcattgaagcaaaattttcttgatttattgccatatcaaccgacaaatgcacaacaaagagttgttgctgaaattgaatatgatctgggacgttctttcccaatgatgcgtttggtacaaggcgatgttggctccggtaaaactttagttgttgctttagctgcattaattgctattgataacggtaaacaggtagcactcatggcaccgactgaaattttggcagagcaacatactgcaaatttccaacattggtttgaaccgttaggaataaaagtgggttgtttgacaggaaaagtaaaaggcaaatctcgtcaagctacattggaggagatatcccaaggcaatatacaaatggttgttggtactcatgccttgtttcaagatgatgtcaagtttgccgaactggtattagttgttattgatgaacaacatcgctttggtgtacatcaacgcctgatgttgcgtgaaaaaggaaagtatgccggtatttatccacatcaattaattatgactgcaacacctattcctcgtacattggcaatggtagcctatgcagatttagatacttcaattattgatgagttacctccgggaagaacaccaattcaaactattgcggtatctgaagaacgcagaaccgaaatcgtcgctagggtgtataatgcttgtgttaatgaaaaacgccaagcgtattgggtttgtactttgattgatgaaagtgaagtattagaagcccaagcagcagaaagtattgcagaggatctacaaaaagccttgccggtactacggattggtttgatacatggcagaatgaaagtgagtgaaaagcaagaagtaatgaggcaatttaaaaatgctgaattgaatttgttggttgctacaacagtaattgaagtcggggttgatgtacctaatgcgagtttaatgattattgaaaatgcggaacgattaggtttggcacaattacatcaattgcgtggtcgggttgggcgtggtagtacggcatcctattgtgttttaatgtataaatcacctttgagtaaagtgtcgagaaaacgtttagaagtaatgcgttcaagtcaagatggcttctttatttctgagcaagatttagaaattcgtggaccgggagaagttttaggtaccaaacagacgggtgttgcagagtttaaagtggctgatttaatacgagatcgtaaaatgctgcctactgttcaacattatgcccgtctattaattacacgatctccaaagttagcagatgacctcattcagcgttggcttaaacataaagaaatttataccaatgcgtaagtgaacatttaacttttgtggaactgagaattatataagtaaagagcggtcaatttttaggaaaattttatgaggttctcaatacaaccaacaattttattttttgattcaggtgtaggtgggttgagtgtttataaagaaactaaacaacttttaccggattgtcattatttatattgttttgataacggattttttccttattcagaaaaggacgaaaaagatattattgaccgcactttaagaatttgtcagaaaatcaatcaaacttatcccttagatttaattgtaattgcttgtaatacggcaagtacggttgttttgcctgaattacgccggaatttttctattcccatcgtgggaaccgtacctgcgatcaagcctgctgcagaaatgtcagaaacaaaacatattggtttgattgcgacgaaaggaactataaaaagaacttatgttaatgatttgattgaaaattatgcacatcattgcatggtggaaaaaattggtagcactaagttggtagagattgcggagcaaaaattacgaggcggtgaagttgatcttaatgtcctaaaacaagaacttagtccatggaaaactatgaaatcacttgattctgttgtattggggtgtacacattttcctctaatcaaagaggaaatagaatgctgtttaccgcaggtaaaattttttgtgagttctggtaaggcaattgcgaaacgggttaaatttttattaaaaggtatagaagtgcggtcaaaaattcagaaaaaaaatttgattttttgtactaaacctcttgaagatgataagtctgttcaacaaattttagattttggggaatttgagaatttagtgatattgtctgattgagaccaagcaactagacaaaaataaaacttgtattttgtaattgaatagatttttactcagataaatgtaggaaaattgagcaaatagtttttattttagacaaaggagaatatttttaaaaaaaattataaaaaaagcttgcattgaaatataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggatgaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccagcagccgcggtaatacgnnnnnnnnnagcgttaatcggaatgactgggcgtaaagggcacgcaggtggtgacttaagtgaggtgtgaaatccccgggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagatgagttctccctaatgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgagtttattttgttagtttatttatattagtaaactaacaaaataaattttggcagtcatagtgcaatggaaccacctaactccttgccgaacttagaagtgaaacgttgttacgccgatggtagtgtggggattccccatgtgagagtaggtcactgccaaatatcaaatttagcggagtggtagttcagctggttagaatacctgcctgtcacgcagggggtcgcgggttcgagtcccgtccattccgccaatttatatctgtttaggggcgtagttcaattggtagagcaccggtctccaaaaccgggtgttgggagttcgatcctctccgcccctgccatgttttccttagtcatatatttcattaaaatttttcatctcatatcttttcatagtttcaaaaatgcaatattctattacaagacgaagaatatgcagcagttaatagaaattttggtggcattttcttatcaaaaaactcagtaaaatctatgtggagacaattgtgggaaataaaatcttaaaagggatttttttgctctatccgccgctgcgttgaatagtagtattggaatttttagcaaaaatttattagagcagaacctaaatattcaatctattgccttttttaaaacaattatcgcttttgctatgatcagtctggtgttaagtcgctcatcatggcaagaacagaaaaatcaagtaaaaccttttgcaaaaaatacagtgaacctacttttccaaatagctatttgcgcatttctggggattttaccttatttttctttgaaaccactgcttatcagtatggccatgccgctaatgtggtagtcgtactaatgaccactgctgccgtatcctccctgctcgtagggctatattattgtcagagccattgaaggtttccgccattgctggcacttgttttgccgtatttggcgtatttatcatttcttggtcgggctctagtcaatggctatctattctatatgccattcttgcaggtagtggctacggtttattttccgtactcatcaaaaaatttaatttaaatggtggcataccattaacacgattattgatgatgtttggagcgctatatttgttctatccatttgtcacacattttcaacatatagaaatccagtggaatacgactgttatactcaatcttgttgcacttgctttactacccacgctgattggtttttactgcacaaccaaggcgttagtttatctcagtgcatcgaaagtacaggtaactgaactgtcagaacctatcttcactatggtactggcatggttactactcaatgaagttccaaatcaaactttctttttaggtgcgttttgtattgtgttaggcattgcgttgatcaatcaaatgttgcaattcaaaaagtgagaagtgagttctaacaggttatgtacgctatgtgtagggtattttgatgggtatgagttttatatttaatcgatacgatttttaggcgagctgaaaactcatttttatacttacttncttcctttcttttctacaaatttaattattttttgtattatttaaataaattaattgagtgatttcaaaaaataagtatgatagccggagttttttgtttatctcttttagggagcttttatgctttatttggaatttttatttttacttttaatgctttatgtaggaagtcgctatggcggtattggattaggtgttgtatccggtattggcttagctatagaggtctttatcttccgtatgccagtaggtaaggcaccaattgatgttatgctaattatccttgctgttgtgacttgtgcatcggtacttgaggctgcgggcggtttgaaatttatgctacaaatggctgaacgtgtattacgtagcaatcctaagcgtgtaactatccttggacctttagtaacatattttatgacatttatgctcggtacagggcattctgtttactctattatgccaattattggtgatgtagcactaaaaaataatattcgtccggaacgacctatggctgcagcatctgttgcatctcaacttgcaattacatctagtccattatcagcggctgttgttttttatcttgggaaaatcaccgcacttccaggatttgagcatattaccttattagatattatttgtgttactgtacctgcgacattggcaggaactattgcattgtcactttatagtttacgccgtggtaaagagcttgaagatgacaaggaatatcaacgtcgtttacaggatcctatttggcgtgagcgtattttaaatacaactagtacaactttaaatgaagtattaccgccagcagctaagcagtcggtatatttatttttactctcgttagttgtgattgtaatgatcgcaatgtttcctgaaattcgtactatcggtagtgcttctaaacctatttcaatgtcattaattattcaaatgatgatgctatgttttggcggtattaccttgttggttacaaaaactaatccacaaattgtaccgaacggtgttgtatttaaatcaggaatggttgcagcaattgctatttttggtattgcctggatgagtgacacttattttcagtatgcaatgccacaatttaaggcaggtattgtagatatggtgaaagcctatccatggacttttgctttggcactatttgctgtttcagttgttattaatagccaagcagcaacagcggttatgatgttacctgttggaattgaattaggtttatctccagcattattagttggtctgatggcggcaacatatgcttatttctttattcctaattatccatcagatattgcaacggtgaactttgatgtgacaggtacaacgaaaattggtaaatattactttaaccatagctttatggctccaggtttaataggcgtttttacggcttgtgtggttggctacctcattgcacaagttgttattcgttaagttcatcaaataaaaagtgcggtttaaaaccgcactcataccgttaacagtttgatacgagagatattccgtaaaaagcaacatcactcagcattgtgaggtaacttttttgctttggttgtttgctaatttgtacttcacgtaattctttgacatgggcatagagatgtttttagaataaaacctcattcaatcgtcaaatgtatcttgctaaaaactatttggaatgatagaatctcaagccattttagtaaattgctgatagttttatactctcagcaatttacattttttaaatacaccgtttgattgcaaaagagttaggctaaatcaaactattagcttaatgcaatccgcacatcagaagtaaggttcagagggcggtacctagcaaacgggttcaagcattgatataaaatttattataaaatcgaccgcactttatgttgtcgaactgaattttatattgaatcggtctcactaatatttacagaggaacccaaatggtttactcctataccgaaaaaaagcgtattcgtaaaagcttcggcaaacgtccgcaagttttaaatgtaccttatttattaacaattcaacttgactcttttgataaatttatccaaagagatcctgacggtcaacaaggtttagaagctgcattccgttctatatttcctattgtcagtaacaatggtaatacagaattgcagtatgtcagttatcaattaggagaacctgtttttgatgtaagagaatgtcaaattcgaggtactacttatgctgcatcattacgtgtaaaattacgccttgttagctacgataaagatgcggcatccggcacgataaaagacataaaagaacaagaagtttatatgggagaaatcccattgatgaccagtaatggtacttttgtcatcaatggtactgagcgtgttgttgtatcacaattacatcggagtccaggtgtattttttgatagtgacaaaggaaaaacccattcatcaggcaaagtactttataatgcacgaattattccttatcgtggttcatggttggattttgaatttgatccgaaagataatttatatgctcgtattgaccgtcgtcgtaaattaccggctactattattttacgtgcattaaattacactaccgaagaaattttggatttattctttgataaggtttcgtttgagatcaaagataataaattactaatgactttagttcctgaaagattgcgaggtgaaaccgcatcttttgatattgaagcgaatggtaaagtgtatattgagcgtggtcgccgtattaccgctcgtcatattaaagcattagaaaaagataagattacacaagttgaagtaccgacagaatatatcgtaggtaaagtttcagctaaagattatgttgatttaacaacaggtgagattatttgtccggcaaatatggaaatttcgttagaattgttagagaaattatcacaagccggttataaaaatattgaaacgttatttaccaacgacctagattttggtccgtacatatctgaaacattacgtgttgatccatcctatgatcgtctaagtgcattagttgaaatttatcgtatgatgcgtccgggggagccaccaacaaaagaggcggcagaaggtttatttgataacttatttttctcttccgaacgttatgatttgtcagctgtaggtcgcatgaaattcaaccgctctttgggcattgaagacactacaggtagcggtacattgagcaaagaagatattgttaatgtaatgcgtaaattgattgacattcgtaatgggcgtggtgaagtagatgatattgaccacttaggtaatcgtcgtattcgttcagtgggtgaaatggctgaaaatcaattccgcattggtttagtccgtgtagaaagagcggtaaaagaacgtctttctttgggcgatttagagtcggttacaccacaagatttaattaatgctaaacctatttcagcagcagtaaaagagttctttggctcttcacaactttctcaattcatggatcaaaacaatccgttatcagaagttactcataaacgtcgtatttctgcattaggtccgggtggtttaacacgtgaacgtgccggctttgaggttcgagatgttcatgcaacgcactatggtcgagtttgtccaattgaaacccctgaggggccaaacattggtttgattaactcgctatctgtttatgcacgtactaatgattatggtttcttagaaacaccatatcgtaaggtagtaaacggtcaagtcacagaagaaattgaatatttatctgcgattgaagaaggaaaatatgttattgctcaggcaaactcaaaccttgacaatgagcttcgttttaccgatgctttcgtaacctgtcgtggtgagcatggtgagtccggattatatcgaccggaagaaattcattatatggatgtttctactcaacaagtagtgtctgttgcagcagcattaattccttttcttgaacatgacgatgcaaaccgtgcattaatgggtgcaaacatgcaacgtcaagcagttccaaccttacgtgctgataaaccgttggtgggaacaggaatggaaaaacctgtagcactggactccggtgtagcggtggtggcaaaacgtggaggtactatccaatatgttgatgcttctcgtattgttgtaaaagtcaatgaagatgaaactattgcgggtgaagcggggattgatatttacaacttaattaaatatacccgttcaaaccagaatacttgtattaaccaaattccttgtgtgcaattgggagaaccgattgaacgtggtgaaatcttagctgatggaccatcaacggatctcggagaacttgcacttggtcaaaatatgcgtgtcgcattcatgccttggaatggttataactttgaagactcaatgttagtgtctgagcgtgtggtacaggaagatcgtttcactactattcatattcaagaattatcttgtgtggcacgagatactaaattaggttctgaagaaattaccgccgatattccaaatgtaggtgaagctgcgttaagtaaacttgatgaatcagggattgtttacatcggtgctgaggttaaaggtggagatattcttgtcggtaaagtaacacctaaaggcgaaacccaattaactccggaagaaaaactgctacgtgctatttttggtgaaaaagcatctgatgttaaagactcttccttgcgtgtacctaacggcacatcaggtacagtcattgatgttcaagtcttcactcgtgatggtgttgaaaaagataaacgtgcattagaaattgaagaaatgcaattaaaacaggctaaaaaagatcttgtagaggaattagagattttagaagccggtttgtttgctcgagtacgtaatttacttctttccggtggtttcaatgataaacaattggaaaacttagaccgcactcaatggttagagcagactttagttgatgaagataaacaaaatcaattagagcaacttgctgaacaatacgaagagttacgtaaagatttcgaacataaacttgaaattaagcgtagtaaaattatccaaggtgatgatttagccccgggagtattgaaagttgtcaaagtttatcttgcagtaaaacgtcaaattcaaccaggtgataaaatggcgggtcgtcatggtaacaaaggggtgatctcgaaaattaaccctgttgaagatatgccatacgatgaaaacggtcaacctgttgatattgtcttgaacccgttaggggtaccatcccgtatgaatatcggtcagattttagaaactcatttgggactggcagctaaaggcattggtgatcaaatcaacgcaatgataaaacaaaaacaagatgttgaaaaattacgtggctatatccaaaaagcttatgatttaggagatggttcacaaaaagttgatctttcgacctttactgacgaagaagtattgcgtttagcaaaaaacttgcgtaaaggtatgccattagcaacgccggtatttgacggtgcacatgagaaagaaatcaaagcgttattagaattaggtgggttaccaacttccggtcaaattaccctgtttgatggtcgtacaggtgaaaaatttgaacgtcctgtaacggtaggttatatgtatatgctgaaattgaaccatttagttgatgacaaaatgcatgctcgttcaacaggttcatatagtcttgttactcagcagccacttggtggtaaagcacagtttggtggtcaacgttttggtgagatggaagtatgggcactggaagcatatggtgcagcctatacattacaagaaatgttaacagtgaaatccgatgatgtgaatggtcgtacgaagatgtataaaaacatcgttggaggcacacaccaaatggatccaggtacgccagaatctttcaatgtaatcatgaaggaaattcgttcattaggtatcaacattgatcttgatgaagagtaatgggtaaccacaaaaatacgcccaagtgcggtgggatttataaaagttttaaccgcacttgaataattttaactccgataggagcaaatcgtgaaagacttagttaagtttttaaaagcacaatcaaaaacctctgaagattttgatgttattaaaattggtttagcatcaccggatatgatccgttcttggtcatatggtgaggttaagaagcctgaaacaattaactaccgtacattcaaacctgagcgtgacggtcttttctgtgcccgtatttttggaccggtaaaagattatgagtgtctatgcggaaaatacaagcgtttgaaacaccgtggagtgatttgtgaaaaatgcggtgttgaagtaacacaagccaaagtacgccgtgaacgcatggggcatattgagcttgcctcacctgttgcacatatttggttcttaaaatcattaccgtcccgtattggtttattgttggatatgccactacgtgatattgagcgtgtactttattttgaatcttacattgttattgaaccgggaatgactgatcttgagagaggtcaattattaacggaagaacaattcttagacgcagaagatcgttggcaggatgagtttgatgcaaaaatgggtgcagaagcaattcaagccttgttacgtgatatggatttagaagttgaatgtgaaacattacgtgaagaattgcaatcaacgaattctgaaactaaacgtaagaaaattacaaaacgtttgaaattgttagaatcttttatccagtcaggcaataagccggagtggatggtgatgacagtattacctgttttaccaccggatctacgcccattagtacctcttgacggagggcgttttgcaacatccgatttgaatgatttatatcgtcgtgtaatcaatcgtaacaaccgtttaaaacgcctattagatttaattgcaccggatattatcgttcgtaacgaaaaacgtatgttacaagagtcagttgatgcgttattagataatggtcgtcgtggtcgtgcaatcaccggttcaaatcgtcgtccgctaaaatctcttgcggatatgattaaaggtaagcaaggtcgtttccgtcagaatttattagggaaacgtgttgattactcaggtcgttccgtcattacagttggtccatacttgcacttacatcaatgcggattgccgaaaaaaatggcattggaattattccgtccatttatctacgctaaattagaaagtcgtggctttgcaacgactattaaagctgcgaaaaaaatggttgagcgtgaagatgctattgtttgggatattcttgccgatgttattcgtgaacacccaattttgctcaaccgtgcaccaacattacaccgtttaggtatccaagcatttgagccaattcttattgagggaaaagctattcagttgcacccgctggtttgtgcggcatttaatgctgacttcgatggtgaccaaatggctgtacacgttccattgacattagaagctcaattggaagctcgtgcattgatgatgtccacaaacaacattttatctccggcgaatggtgagccgattattgttccttcacaagacgttgtattaggtctttactatatgacacgtgataaagtcaacggtaaaggcgagggaatgttattacaagattcacgtgaagcagaaaaagcctatcgtacaggtcaagctgaattgcattctcgtgtaaaagtgcgtattactgaatatgttaaaaatgcaattggtgaatttgaacctcaaacacatttagtcgatactacaattggtcgtgcaattttatggatgattgcaccaaaaggcatgccatttagtttattcaaccaaactttaggtaaaaaagcgatttctaaattaatcaacgaaagttatcgtcgtctaggattgaaagagagtgtattgtttgctgaccatattatgtataccggttttgcttatgctgcacgttccggttcatctgttggtattgatgacatggttattcctcagaaaaaatatgaaattatttctgctgcggaagaagaggttgctgaaattcaagaacaattccaatccggtcttgtaacagctggtgaacgctataacaaagtaattgatatttgggctgcggcaaacgaacgtgttgctaaagcgatgatggaaaatctttcgcaagaagaggttatcaatcgtgaagggcagccggaaaaacaagcctcattcaatagcatctttatgatggcagattctggtgctcgtggttctgcggcacagattcgtcagttagcggggatgcgtggtctaatggcacgtccggatggctcaatcattgaaacaccgattacagcaaatttccgtgagggtttaaatgtattacagtactttatttcaacccacggggcacgtaaaggtcttgcggatacagcattaaaaaccgctaactcaggttatctaacccgtcgtttagttgatgttgcacaggacttagtgattatcgaagatgactgtggtacacatgaaggaatcgtaatgactccacttatcgagggtggcgatgtaaaagaagcattacgtgatcgtgtattaggtcgtgtagcggcagaagatattttaaaaccaggcacaaacgaagtgttaatttctcgtaataccttattagatgaaaaactttgtgatgtcattgatgaaaattctgttgatagcatcaaagtgcggtctgttgtaacttgcgatactgattttggtgtgtgtgcaaaatgttacggacgtgatttagcacgtggacatttgattaatcaaggtgaagctgtcggtgttattgccgctcaatcaatcggtgaaccgggtacacagttaaccatgcgtacattccatatcggtggtgcggcatctgctgcggcaaaagaatccagtgttcaagttaaaaataccggtacattacgtttaacaaatgttaaattcgtaacgaataaagaagggaagttagttttaacttcacgtaacactgagttgacaattattgatacattcggaagaacaaaagagcattataaagtaccttatggtgcggtattaaatcatgctgatggtgaagaagttacggcaggtgaaaccgtggctaattgggatcctcatacaatgcctgttatttctgaagtcagtggttttgtgaagtttgtggagattgttgatggactaacggtaactcgccaaaccgatgaattaacagggttatcttcaatcgtagttcaagatgtaggtgaacgtgcaacagcagggaaagatttacgtccggcattaaaactggttgacgctcaaggtaacgatatttttatcccaggcaccgatgttatggcacaatatttcttaccgggtaaagcaattgttagcttagatgatggtgcggaagtctttgttggtgaaccattggctcgtattccacaagagtctgtaggaacaaaagatattaccggtggtcttcctcgtgtagcagatttatttgaggcacgtaaaccaaaagaaccggcaattttagctgaaatttctggtatcgtgtctttcggtaaagaaaccaaaggtaaacgtcgtttgttaattacaccgatggaaggtgaaacatacgaagaaatgattccaaaatggcgtcaattgaacgtatttgaaggtgagttggtgcaacgtggtgatttaatttctgatggtgcggaaacaccacatgatattttacgtttacgtggtgtacatgccgtaacagattatatcgttaatgaagttcaagaagtttaccgcttacaaggggtaaaaattaacgataaacatattgaagttatcgtacgtcaaatgttacgcaaagcgattatcactaatgcttatgactctgaattcttagagggagagcaggtcgaagtcgctagagttaaaattgtcaaccgtaaacgtgccgaggaaggtaagccacttgtagaattcgaacgtgaattattagggattactaaagcgtcgttggcaacggaatcctttatttcagcggcttcgttccaagaaacaactcgtgttctaactgaagcggcagttgcaggtaaacgtgatgaattgcgtggcttaaaagaaaacgtgattgtaggtcgcttaattcctgctggtacaggttttgcatatcaccaaaaccgccaaaaaaatcgattggtaggtggtatggaaaatacgactgaggttaaattatctgcagttgatgaggaagaaattgcttctgaatttaccttttcagcagaagatgcaacagcaaatttggcagagatgctaaatatggcagatgatgcagaataataagtagcttggtacaaaatatttaattttaaaaaccgatatttatgtttgtaaatatcggttttattgtttagataataaagtacatgcaacattattaaaaccgaaaatctgtgtcatattcaatgatcacgactattgttcaaaattttctgtaatatagaggaaacggagaaacttcatttttaaaggatttgctgaaaggtattttgtatgaaaaaagctttcaacagtgtgaaatgcctgctataacttttgtaattttcgtttccgttttatacaatattcagcaacataaatgtcttcaagtaattaaccttaatagtggaacacctcatggaaaaaagcttatcccttattcctaatatcagaatgaaacgagaaggaatgacaaatacggaaaaacgagtagttgactggttattagatgcaactaaatttaataaatccacagcattgaatgctattgcaaatgatcttgacgtatctgaggctttaattgtaaaagttgcaaaattactcggtttctccggttttcgtgatttaagaaaacaaatcactacttcttttgaagaaaatcaattagatacatttgaactttccagtcaagatacgcctcaagatcttgtagataaggtttttaatgtctctttacaaacaatctctgaaggcaaggcgattttaaattccaaagtcatttctgaagctgcaaaatgcttttttaatgctcaaaatagagatctgtatgctgctggtggttcaaatacaatctgcgatgatattgaacataaattcttgcgtatcggaattcgctgtaatacctatcgagatattcatttaatgatgatgtcagcctcattactcactgaaaatgatgtgatcttagtggtttctcattcgggtaaaacaaccgatttgttaaaagctgtctatgaagctaaaaaaaatggagcaaaaattatctgcatcacacatagtgatatttctcctattgctgttatttcggattttgtaatttgtacgcccgcaccagatactccattgctgggaaaaaatgcttcagcaagaattttacaacttattttagttgatgccttctttgtctctgtagctcaacaaaatattcacttatctgaaatgaacttagagaagacatttactgcaacaaaatacttcagaaaaaaatagcttccttccattaaaaaggtccttttttatcattaaaaactttacaatattttaatatttgtgaagttgatcacttttttacccctttcaataaagtataattataaaaaaataaataaaaattataaaaatatgaagtttaatcattttttataatttttagttttctattaacttacataaggagtaatttcatgaaaaggttcaaaacactaaaatcctgtttggctatacttggcttagtttgctctgtttcggtttattctgctgaatatgccgtaatacttaaaacgctttcaaatcctttttgggtagcaatgaaagaagggattgaaaatgaggcaaaagcactgggagtagatgtagatatttttgcttcaccatctgaaggtgattatcaatcacaacttcaattatttgaagatttaatcaataagaattataaaggtatcgcttttgctccactttctcctgcaaatcttgttatgcctgctgccaaagcctatcggaaaggtatttatcttgtgaatttagatgaaaaaatcgatattaaaaatttacaaaaggcaaaaggcaatgtagaggcatttatcacaacagataacgtagctgtaggtggaaaggctgctcaatttatagtagataaattaggttctgaaggaggcgaagttgccattattgaaggaaaagcaggcaatgcttcgggtgaagctcgtcgtcgtggagcaagagaagtttttgttaaaagttcgagcattaaattagttgctagtcaacctgcagattgggatcgtattaaagcactggatgtagcaaccaatgtactatcaagaaatccaaatctaaaagccttttatgtcgcaaatgatacgatggcaatgggggtagcacaagctgttattaatgctgggaaacaaggtaaaattttagttgtgggtaccgatggagttcctgaagcaagaaaaatggttagcgaaagaaaactcactgccactatcgctcaagatccggcaatgattggtgcaaaagggttgaaactgcttgttgatgcagcgagagcaggaaaacaaatacctgttgatgttgagccaaaaattgaaactgttgattcgatattaatttctcaataatacggaagtatgtggggattttaatctccacataggagtgtttttctatggcaatcccattaatacaaatgaaaaatatctcaaaaagttttggtgttgttcgggcattaaaaaatgtcaatcttgatatttatacgaatgaaattcacgcattactgggtgagaatggagcgggtaaatcaactttaatgaaagtcttatcaggattgcatatgccttcctccggttcaattatcattaaagataaagaatatgatcatttagatcacaaaatcgcaacagaacttggaattgggattatttatcaagaattaagtttaattgatgaattaagcgtacttgaaaatctttatatcggtcgtttaccaacaaaaaaattttggggtattcccattgttgattggtcaaaaatgcgttctcaagcgtctattattttattaagactaggaattaaagttgacttagatgagaaagtaggaaatttatctatttcttacaagcaaatgattgaaattgctaaagttcttatttcagatgtaaaaatcatcattatggatgaacctacctcatcattgactaactcagaaattgattacttatttttcattatgaatcaattacgtaatgatggaaaagcgattatctacatttctcataaaatgaatgaaattcgccaaatttgtgaccgttatacgattcttaaggacggaagtagtatggcttccggtatgataaaagaaatcagtaatcaagagattatccgcttgatggtaggacgtgatatagaatctcggtttatcagcagacaacatactgtgagtaatgaggttatttttgaagttaaaaatcttacaggtagaaaagttaaacaagtcaataatgtttcattttccttaaaaaaaggggagattttaggctttgccgggttagttggtgcaggtcgtacagagttgatgaactgtatctttggcattgataaacgcatttctggggaaatttatttaaacggtaaaaagattacaccgtcatcaccattagaagcagtgaaaaaaggtatggcgtatatcacagaaagcaggcgtgagaatggctttttttccaatttttctatcaagcaaaatattgctgtttcaaaaagtttaaaagatggtggttataaaggtgcggtgggaattttttctccttcaaaggaagccaaacttgcacaacagcaacaagatcttttatccataaaatgtgcgtccattgagcaaaatattacggagctgtcaggtggtaaccaacaaaaagttattatcggaaaatggattgtttgtgatcctgaagtattaatttttgatgaaccgaccagaggtattgatataggggcaaaaacagaaatttataaaattatgcgtcaattagcagaacagggaaaagctattttgatggtctcttccgaacttcccgaaattatgtctgtatgtgatcgcattgtggtattccgagaaggagctatttcctctattttagagaatactaaagcgttaacagaagaaactattatgcgttgggctttaccagagacaaaagaggtaaattaatgatgaatacaggtaaatttaatttttcgcaattttgggataaatacggcacattctttattcttgctgttattgtccttatctttggatctatatccagccaatattttttgaaagccagtaatattcagcaaatttttgttcaaagctcggtaacagtcctaattggaatgggggaatttttcgctatattgatagctggtattgatttgtctgttggtgctattttagctctttcggggatggtgacagcacagttaatgattataggggtagatcctcttgttgcctctattattggtggcattctagtgggaggtggacttggtgctattaatggtgcgttagtcaattacacaggcttacatccttttattattacattaggcacaaatgccatttttagaggtattacactcgttatttcagatgcaaattcgatttacggcttttcttttgagtttgttgatttttttgctcaggatattttcttcattcctgtaccagttatattcgttgtggttattgctattctactttggttcgttacaactaaaacacgattaggtcgtaatatctatgcgttaggtggaaataaagaatcagcatattattccggaattgatgtcaagtttcacactatggcggtctttattatttcaggtatctgtgccggtcttgccggtgttgtttctacggctcgattaggtgcagcagagccgttggcgggggttggttttgaaacttatgcgatagcaagtgcgattatcggcggaaccagttttttcggaggaaaaggacgtatttttgctgtcgttattggtggcttaattatcggtacgatcaataacggactaaatattttacaagttcaaacttactatcaacttgtggttatgggtggtttaatcatcatcgctgtcgcattggatagattaattagtcgttaattttttgaggtaacatcatgaaagtttttatttcaccatcactcatgtgcatggatcttactaaattcaaagaacagattgagtttttggatcacaaagtagcttattttcatattgatattatggacggtcattatgtacctaacttaactctttcaccattttttgttagtcaagttaaaaaactcgctacgaaaccattggattgccatcttatggtaactaacccagaaaattatattgatgatttggctaaagcgggttgcgacatgatcactttgcatgtagaaaccatttcaggacaagcatttagacttattgaaaagatccggcatttagaaatgaaagtcggcatcatttttaatcctgaaacgccaattgaaaaagcaaaatattatttacctaaagccgataaagttacgatattgacggtcgatcctggatttgcaggtcaatcatttattcctgaaatgttagaaaaagtggcggaacttaaattattccgagaaactcataaattaaattatgaaattgaaatcgatggctcctgcaacccgaagacttatgaaatgcttattaaggcaggtgcggatgtgcttatagtaggaagttcaggtcttttcaataattcagataatattgttgaggcttgggatatgcttgaaaaagagatagaaagaatattaagtaaaggaatgttgtaatgaagaaagtatttgttggtattgatatgggggcaacacacattcgcatttgtgtgatggatgagcatcatcaaattctttctactgataaaaggaaaacattagaagtactcaaaaatcaaccgctctatggactaacaacattttgtaaagaatttacaactgactttactattcaacgaattgttataggacttcctgcagcagtttcattggatagaaaagaaattctttctgtacctaacttatctctttctaaacaagaactagacggacttgttccaatgttagagcaatattttcattgtgacgtacaattggaaagagatgttaatttacaattgatctacgatgttaatgattatcaacggaataataagttagtgataggtgtttatctaggcactgggatgggtttttcaatatggaaccaaggaaagctatttattggcgggcatggtgtagcgggtgaacttggacatattccttacggtgatgaacatcttcaatgcgggtgtggcaatatgggatgtttggaaactaactgttcagggactgcactaagaaaatggtatgataaacaacaagcaaattatccattagagcaactttttgatagagcaattcaagagaaattcattcaaaattatcttatcaaagtcgctaaagcaattagtactgcggttaatttatttgatcctcatactttgattttgggcggtggcgtaattgacatgcaaaaattcccatttgaacaactaaaaatattgatcagaaaacacctgagaaaaccattaccttacaatgaattagaaatattaaaagctaaaccttcctctattaatggggcaataggcggagctatttacgctataaataaggagaaatgatgaaaacaatcgctattggttcggatcatattggtttggctctcaaaacctttttaattgaaaaattagaaaaacagggtcataacttactagacttaggtgctgtttcacaagaacgtacagattaccctatttacgctgaaaaagttgcttatgctgttaagcagaatgtagctgatgttggaattttaatctgtggaacaggagttggcatttctattgcagcaaataaaatctcaggcattcgatgtgcattatgttcagatgaacttaccgcactaatgtgtcgtgaacataacaactgcaatatcattgcatttggtgccaatattatatcttcagaaaaagcgatatccttagcaacactttggctgaatacgccctatgacggaggacgacatcaaaaacgccttgacatgatggaaatgcttgaaaaaacaggaagttattgtggattggttactgaaagataaaatctataaaataatataaatatttaagaatatttaaattatgctataaccacacctatgaataaacttttctctatcggacaagccagtaaattgctaagcgtaactattcagacattgcaaaactgaggtaggaaagactgttacaacctgatgagctgaccaaaggttggtatcgcagatataaactggaaatgcttaaagcaattaatcacaatatcgtgcttaatcgagatgatttaaaaaccatttcttatgcaagagtaagtagccacgctcagaaagaagattttgttcttataggtttgttttccttgtgaataatctaaccaaatattactcggatttaatttctttttgaaagcaaaaattttattacagcagatacatctaaaacgttttttggtgaggcaatctgttattagaaaggatttaaaatgttgggggtatttgtgttggaatccccgccctttaggacggggaggtgttgagttttagttatagaataaagtggcttaaatcttcgttctctacgacatcacctaatgctccggtaacgtaatcgccgtcaattatgacgttttgaccgttcatttcactggcattaaaagagatcttatccattaagcgttccataacggtatgtaaacggcgagctccgatgttctctgttttttcattgactctaaaggctgcttcagcgatttttttcaccgcactttcagtaaattcaatatcaaccccttcggttgccatcagtgcttgatattgttcggttagggacgcattaggttcagttaaaattcgttcaaaatccttggcagttaatgcggaaagttcgacacgaataggtaaacgcccttgtaattcgggaattaaatctgacgggcgagcgacttggaatgcccctgatgcaataaataaaatgtgatcggtttttaccataccgtgtttggtattgactgttgaaccttccactaatggcaatagatctcgttgtacgccttcacgagatacatcagcaccgctgtattcgccttttttgcagattttgtcaatttcgtcaataaagacaattccattttgttcaacggcatcaatggctttttgttttaattcttcaggattaattagttttgccgcctcgtcatcaattaatgcttttaacgcatctttgattttcattttgcgttttttagtttgaccggaagataaattctggaacattgattgcaattgattggtcatttcttccataccgggaggtgccataatttcaacgccgatatttggtgcggcaatgtcaatttcaatttcacgatcgtccaattgcccctcacgtaatttcttgcgaaaaatttggcgtgtgttagtattggtatctcgttcttcaatttgtccccattgatctttcgctgggggtaatagggtatctaaaactcgctcttccgccatttcttcagcacgaaaacgatttttttcaatttctgtttggcgtacaagtttcatggcactatctgttaagtcacggataattgaatcaacttctttacccacatagcctacttccgtaaattttgttgcttcaactttgataaatggtgcattagctaatttagccagacggcgggcgatttctgttttacctacgccggtaggtcctatcattaaaatattttttggggtgacttcatggcgtaagggttcttgtaattgcattctacgccagcgatttcttaaggcaatagcaaccgctcttttggcatcagcttgtccaatgatatgttgatctaattcagaaacaatttcacgaggggtcatttcagacataatatattccttgacaattattcggataattcttcgatagtgtgggttaaattggtgaatacacaaatatcaccggcaatttttaatgatttttctacaatttcacgtgcggataaatccgtattttcgactaatgctcgtgctgcagataatgcataatttccgccagatccgatcgctaaaatttgatcttcttccggttgtaccacatcgccattaccggtaataattaacgattctgttttatcagcaacaataagcattgcttctaaacggcgtaatgctctgtctgtacgccattctttagccaattccaccgcactttttaacaaatgtccttggtgcatttccaatttacgctcaaaaagttcaaataacgtgaaggcatctgctgtaccaccggcaaatcctgttagaaccttaccgttgtatagacggcggactttacgtgcattgcctttcattactgtattgccgagtgatacttgtccatcaccgccaaccacgacttgccctttacggcgaacgctgacaattgtagtcatttttgattccttaactttcttttcttttatctgtcgctatatgaggattaactgtgacctttcaaggatatatacaaaataaaattttgatttttgtagagggatagaatttaacattcttatttgaagcactaaaggagcgattgcattgaaattgattggacaatcgccgagattatattaacaatctgtcggatcaagtcgctaaatacagaaaatctctttataatgaccgcacttttaccgcaagtgcggtttctttttactatttttaaaggaagataaaatgacggtattgaaaaatgatcgttacttgaaagcgttactacgtgaacctgtggatatgacgcccgtttggatgatgcgtcaagccggacgttatttaccggaatataaagcaactcgtgcaaaagcaggggattttatgtccctttgccgtaatgccgatttagcttgtgaagtgactttgcaacctttacgtcgctatgatctggatgctgctattttattttcggatattctgactatccctgatgctatggggctgggattgagttttggtgtgggcgaaggtcctaaatttgcacgaccaattgataacaaaagtgcggtacaaaatcttccgattcccgaccctgaacaagagttacagtatgtgatgaatgcggtacgtactattcgccgtgagttaaaaggtgaagttcctcttatcggtttttccggaagtccttggactttagcaacctacatggttgaaggcggaagcagtaaagcctttactaaaatcaaaaaaatgatgtattccgagccaaaaatattgcatctgttattggataagttagcagacgccgtgatactttatcttaatgcacaaattaacgctggtgtgcaggcggtgatggttttcgatacgtggggcggtgtattgggacatcgtgaatatttggatttctcattgcaatatatgcacaaaattgttgatggcttaattcgtgaaaatgacggatataaagtgccagttactttgtttacgaaaggtggtggtttgtggttagaggcaatggcaagtacggggtgtgatgcactaggtttagattggacggtaaatttagcagaggcaaaagcacgagttgggcataaagttgcgttacaaggaaatatggatccttccgtattatatgcttcgcctgcacgaattgagcaggaagtacaacaaattcttgccgattttggacaaggtagcggacatgtgtttaacttaggacatggtattcatcaagatgttccggaaattagtccgaaggtttttgtggatgctgttcatcaatattcaatattctatcatcaataaaagtgcggtgaaaataatgcgaaatcctattcataaacgcttagaaaaatttgaaagttggaaaaatatcacatttatgctgtgtttatgtgaacgtatgtaccccaatttttatttattttgtcaaatgacagagcaaatggataaagccaaaatatatcaaaatattttgaatttagtttgggaatatttaaccgttaaaaatgccaaaattaattttgaaaatcagttggaaaaattagaaaatattattcctgatgtgaataattatgaattttttggtgttgtaccggcattagatgcctgtgaaggcttatcggaattattacatgcaattattgctggagaaacactggagaaagcaataaaaataagtcagttgtcgttgcaaactgtgataactttgctggaaactcagcaagacaaagcgttttctgaagccgagttgaagcaaagtgaagaaattgaattggaattggatgtacagtggcaaatttatcgtacgctgaatgagcctgaagaaagagatattagactgattttagatttaaaaaatgagttaagagagagcagggtgtctaatatcggtatagaaattgctcaataatgtgatttagttatcaatttttacagatattacttttttttctataaaacttagattatgcttgacaccactgtagttgcagtaattgttgccgctggaagatgagctatctttttcggcacttttaaaaaaatttaatatgaagaaggtactaatttatgaataagacagacttaattgatgcgatcgcaggcgcagcagaattaaataaaaaacaagcaaaagcggcgttagaagcaaccttaggtgcaattgccggcagtttaaaagcaggtgaagctgtgcagttaatcggttttggtacatttaaagttaacgagcgtaaggctcgtaccggtcgtaacccacaaaccggtgcagaaatccaaattgcagcatcaaaagtaccagcatttgtagcaggtaaagcgttaaaagactcggtaaatagctaagttatttttctctatctactttaaacctcgcatttgcgaggttttttgttatcttattttttctctacctctacctctacctttctttctaaatcaaaacgtatttacaattctttttttttatgtaaaattcgaaacgaaatttaaattatggtttttttatgaaacgaaacttttatcctaggaataccgaacagcgtcgtcaagtgataatgcagttactgcaagacaagggagagattagtgttgagcagttagtgcagtattttaatacatctgaagtgactattcgcaaggatcttagtgcattagaaagtagtggttttttattacgtaagtacggaggagcagttttaataccgcaagagccattggaagcaaatcacgaagaattactttctaatcgaaagttagctattgcaaaagcagctgcggaacgtattgctgataacaacagaattattatagatagcggtagtacaacagccgcacttattaagcaattaaataataaacaaggcttagttgttatgactaattctttgtctgttgcgaatcaattacgatctttggagcatgcacctacattattaatgaccggtggtacatgggataccggatctgaatcatttcaaggcaaagtagctgaacaagtattgtattcttataactttgatcaattatttattggtgcagatggtattgatttagctagaggaacgacaacgtttaatgaacttgttgggttaagtcaggtcatggcagaggttgctcaagaagttattgtcatggtggagtcacaaaaaattggtagaaaaatgcctaatttagaattaacttggcagcaaattgatgtattgattaccgatgagctattgagtgataaagttaaaaagcaaattgaattacttggcgtagaagtagtctgcgtaagtgcggtataaatttttttattttaaggaagtaattatgtgtggaattgtcggtgcagtggcacaacgtgatgtggcaaaaattttaattgatggattatatcgtttggaatatcgagggtatgattctgctggtgttgcaatattaaatgagcaacgtcatgtacaaattgtacgcagagtcggtaaggttcaggcattagatgacgcaattgaaaagcaacagttatctggaggaacgggaattgcacatacacgttgggcaacacatggggagccttcagaaattaatgctcacccacattgttcgggaaaaattattgttgtacataatgggattatcgaaaattaccaagaattacaagaagttttacaacaacgaggatacatttttcaatctcagacagatacggaagtgattgctcatttagttgaatgggaattgcgtagtgcaaacactttactggaggcggtacaaaaagcgattgctcaattgcgaggcgcttatggaaccgttgtgatgaaccaagatgagccggagcatttgattgtggcccgttccggcagtccgttagtcattgggttaggtataggagaaaattttttagcttcggatccccttgcattattaaatgtaacacaccgttttatctatctcgaggagggtgatgttgcagaaattacatgccacagcgtagatatttttgattttaatggtaaacaagtagagcgagcagttcataagaataattttgagacagatgtaatagataagggaccttatcgccactatatgcaaaaagaaatttttgagcaaccgcaggcaatcatgaatactttagatgggcgtattttaaatggacaggttaatattgaagctattgcaccgaatgcagaggaaattttacggcaagtagaacatattcaaattgttgcttgtgggacttcttataatgcgggtatggttgcacgttattggtttgaatctattgcgagagtgagttgtgatgtggaaattgcatctgagtttcgctatcgcaagtctgtaactagaccaaatagtttatttattaccctttctcaatcgggcgaaacggctgatacattagccgcattgcgtttagcaaaacaatccggatatatgtcagtcatgactatttgcaatatagccagttcatcacttgttagagagtctgattttgcctttatgacacgtgcaggggttgaaattggagttgcttcgacaaaagcgtttacaacacaattaacctgtttactcttattaaatgtagcacttggtcgtattaaaggatctattaatgtagaacaggaacgtaatatcattcgatccttacaacgtttaccggctcaggttgagagtgctttggtttttgataagcaaattcaaaaattatcagaagattttgcagaaaaacatcatactttatttttaggacgtggtgagtattatccgatagcgatggaatctgcattaaaattaaaagaaatttcttatattcatgcagaggcttatgccgcaggtgaattgaaacacggacctttagcattaattgatggtgatatgcctgttattgttgttgcaccggaaaatgatttgctggaaaaggtgaaatctaatattgaagaagtgcgtgctcgtggcgggcgattatatatttttgctgatcatgagttcggttttggtaatagcgatagttttaaaacgttggtattgccaaaagttgatgctatcacagcaccaattttttatacggtacctttgcagttattgtcttactacattgctttaattaaaggcactgatgtggatcaaccccgtaatttggcaaaagcagttacagttgaataaaaaatagtaaaagtgcggtaaaatttaccgcactttggttatttgattcaagttgctaccgtaaacagctattaccagccttttgcgacaccgtctttaaagtgtttgtaagcttcttgataaacttcctctgtttgataggcttttacaaagttttgtacttctacgctgtctttattatctttacgagcaacaataatattgacgtatggagaatctttatcttcagtaaagataccatgttctgcactgtttaaaccgacttgacctgcgtaagtattattgacaacagctaaagctacatcatctaacgcacgagcggcaacagaagtatctacttctttaatctctaaatttttcggattttcgataatatccaatgcagtagagaataaatttgtattatcttttaatttaattaatccttgtttttctaataaaatcaacgcacgagccaaattgcttggatcgttaggtacggcaactgtatcaccgtctttcaattcactgatattcttaatttttttagaatagccggcaagcggataaacaaaggtgttacctacaatttccaagttggtgatatttttagattgtgtatctttatctaaataaggcttatgttgcattgcgttaatatctaaatcaccttttgatacagcagtgttaggtaatgcgtaatcattaaatatgacaaattccactgctaagttatatttttctttagcaatctgagctgctttttctgccacttgatgttcaggacctgccattacgccgactttaatttttgccggtttgttttgatttgctactgtttctgtttttttatcatcgttacaagctgtcaaggcaacagttgaagcaatggcaatagttgcgaaaagtttgtttaatttcataagatttcctcttaaatagttgtgtttaaaataaattagcgatgatcaacttttttagctaaatcatcccctagtttttggctaataataacaaataacacgatgataatggttgaaatccaagtgatgaatcccataccacgatgtactccgtagttaatagctaaacttcctaaaccacctcctccttgggttccagccattgcagtatagccaattagcgttacaaaagttaatgtaattccattgataagagagggtagagcctcaggtaaatagaattttgtaataatttgccaattggtagcacccaatgcttttgctgtttctgtcagtccggttggaatttcaaataaggcattgctggttaagcgagcaaaaaatggaattgcagcgacacttaaagaaacaatagcggcattagttcctaatgaggagccaacgatatagcttgttacaggaattaagatcaataacaaaataatataggggatagatcgacctatattaataatgacattgaaaattttattagcattgctattttctagaatttgttttttgcccgttaaaaaggttatgcaaccaataggtaaaccgatgaggactgcgataaacgttgacacaatcgtcatataaacggtttcccaagtagaaatagcaattttgctccacatttccggcgttaattgttgattgaacgtaattagcagattatccaacatagcctaatacctccacacggacgttattttccattaaataaattttagtttgcgagatggcttcttcctcaccttcaacttcggcaataacaaagccgaattttacctcaccggcgtaatctatttgtgaacttaaaatactgagatcgacgccaaattgtttagatgcttgagataataacggtgcatcaacggagcgaccggtaaattcaaatttgataattgggtaagattttgcatgttttggcgttgccgataaattttccatatattcttccggtagattaatatggaaagttgaatgaataaactcttgagcaagaagggttttcggattagagaaaatatctccgacagaaccttgttcaattaattgccctttattaattaccgcaacttgatcgcaaatacgtttcaccacatccatttcgtgtgtaatcagtaaaatggtgatacctaaagtgcggttaatttcttttaataattttaaaatagattgtgttgtagccggatctaatgcactggttgcttcatcgcacagcaataccttaggactgtttgcaagtgcacgagcaatagcaacacgctgtttttgtccgccggataaatttgccggatagacatcttttttatcatatagtcctactaaatttaaaagagcgtcaactttttgtttaatttgggttttatccgttttctctagttctagcggcagtgcaacgttatcaaagactgtgcgtgagcttaataaattaaagtgctgaaagatcataccaatatgacgacgagcatgaattaactcgttatctgaaagttgagttaaatctgtattatctacaatgacagagcctgaagttggacgctccaataaattgatgcaacgaataagagtactctttcctgctccggaggcaccaattactccacatatttgtcctcgaggtacttcaagactgacattatcaagtgcggtcagatttttgcctgaaacattgaacactttactgatattttttagcttaatcatataagcccttttctatatagttaaattaaaattagcttgtattttagacgtctagattgctatgtcaatatttattgaatagatttttataaggatttattagttattggcgatataataaagaaactttgtttttcatagaggtattatgtatatgaataaagcgatttttttagatcgagacggcacgttaaatatcgatcacggttatgtgcatgaaattgacaaattccagtttatagcaggaagcatagaagcattgaaacaacttaaatctatgggatttttattggttttagtcacaaatcagtccggcattgcaagggggtatttttctgaggaacaatttttacagctcactgaatggatggattggtctcttgcagacagaggcgttgatttagatggtatttactattgtcctcatcacttagaaggaatcggggagtataaacaagattgtgattgtcgtaagcctaaaaatggcatgctactgcaagcaataaaagaattaaacattgatcctgcaagatcttttatggtgggagataagaaagaagaccttttggcggggaaaagtgcggggataaaaaagaatattttggtcagaagcggtaaagaaatcaccgatgacggattgtctttggctgattatgtgttggatactattgctgatttacccgaattaataaaaaaattaaaattttaaccgcactttttattaaaaaattaggctatgtcttaaaataagattgaatgatgaaattcagttttttgcgttctgtttgcataattgctcattctgtacatacaaaaagagataacatttctgctatctctaatgcctacaatcatattttttagtttctacctacaagctgttttgttgcttcaattttcttatctttccacataacaacatcttttataacaagtttttggacagcagaaataagaagttccatataggaaaagtctatttcgttattttttgttggcagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaacgcttctttttcctcactagacaattcataattgtctagtccgcttaccgttaggtaagcggagagttcacttatacgctcctcttcgagttcacttataaagctctccataaattcaaaatctatttttccattttttattggtagttggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaacaaatccctaattctatactcgccccactgaacattttggagtttttcattcagtggggcatttatttttttaggtctttattctccttatctgtatctttaagaagattagatacttcccaagcaaggtaatcagctacagttttcttgaaatcttcaagagttggtcttgtatctatcggtgctgattgattccagtctgaaccatttaaagggtcaatatgaccttcgtaatattctttttctgtaaagatgtttaatttttgttttccaaaacgcacaaggtctactacttcttgatatctttcttttgctctgtcggtatctctaagatttacacttgctttttttctgttcgttcttgtgtatccatcgtttgaaaagtcgataaacttcacaacttcatctctttgatgagattcgcctactctaaatacataaatatttgtttgaacacttgattttccaacaaataaatcgatgggcattttaatacttgcaagtagtgtattttttgctagtatcttcttgttaagttcttttgcttttccacttcctgcagagttttgaatgatgattgctgcatagcccttgttcatcatagatagggctttttctacgaaaatcattccattgccctctgctgaataaggcggatttaacacaaaagcagtagctggaaatttctcatctgttttaccaaatccatatttaccgtcaaaatcatgtagcgagtctttatttaagatgtttgagctaccatctcccataagtatcatatttaaaatggcaagcatatagatgttggatagaacttctaagcctaaaagctgttctgcttttatctttagttgtttttgctctagctcaagtggtgatgtgatttttgcttttgcatctataatcatctcgttcattgcagcaacaagtagccccgcacttcccgttgcaaaatcccacacatagctgtctttatcaactcttgcaagttttactaaaaaagttgctacataagatggggttaaaaccacatcgtttaatttgtcttgcgtaaagccgagccaagagtacatttcattaaagagcttacctgtaaagtctgtagttaagcctattttgtagtaaatacctaaatcgtctacgatttttgaaaatattctttttaattggctttctccgtttattggcttattaatattttctgataataatgtattttttagtgttcttacgataaggtcttgttttgtttttggtaggtttttcttttgtaaaaacgcttttatttttctaacgatcttttcgccgtctgtgtttccctcttctattgatgattttaggtcagacttttctagtggacttacccccccccggtattcctagtgttgccataatagaagctgacacaagatagactctgtcgttttcactaagccctttttcatttgcgtaaatatcattgtttagctttactaaacttgcatttatttctttttcacgtttttctttaagtgcttcaagctcttcagcagataaagaaagttcgtttacttttttaataaaatctgtaaagttttcttttcttaaaaatgaaaggtctgtgtattttcctacttcttgccctatcccaaaattatcttttgatacatagtaaacgccaatagagtgttctatttccccgttttcttttttatatcccgtaacaccgattgctattacatctgtgtagcttgtgtagtgaagtatggcattggcataatgaaccgctccatttacagcatagctattaatatttttgtaattaggctcgtttttacttgttctattgtcaactctaccgtcaatgtctaactttactaatttatctttatatcctttatattctatcagtattggataatagttaagtgcctcatcttgcaataaaagttttgcatccggtctatttccacccgttccgccactttttgatttatattcatcaagtgccttatctatttgtgcatttagactttcttgttctaatttataatccagcccataacttttaagccacccatttacaaggtcaactatgtttggttctatagattgcattttaaccattgtctattctcccttttcaacatattcatcatcaaaagaaaatccatcgttcggcgtgcagtcaaatgccttgaatattctctctaaatttttaagtgttatcggtttatttttcccatttttgccataatattggttgttaaatctgacattgttataacatcaattttccttaagcctgtcaatcgtattttagaatgcaaccaaaaattatcttaaaaacccttaataataagggctttgggtgagagagtttttaatgagaacgttgtactagcaagtgcattctggcgatattttgagcggtagattctagattttgtctgccttgagccaaaatttcaggcaaactgtctaattgacgaataatggggaatactgcatcaatgccatgctcatagactacttcataatcttcccgtaagcagcctgtaatggctataacaggtttatttgccagtttggcagtttttgctactccaataggcgttttgccgtgaatagtttgtgaatccattctaccttctccggtaatgaccaaatcggcatccttgataatttctgctaaatttactgtatcaatgacaatctgcacaccggatttgagttgtacttgaggcaataatagcaatccaccacccataccgcctgcagcacccgatccgggacgctcagcaatccgttttccgcaatctcgttctacaatacggctaaaatgcagtagagcttggtccaattgttgcaccatttccggtgttgctcctttttgtggaccgaaagtagcagaagcacctttttcaccatataaaggattatttacgtcgcaagctacattaaattgaacttgtgtcaaacgttgatctaaatgtgcagagtcgatatgagcgatttgttgcagagctagaccgcccaagccgatttcttttccttgagcgtctttgaatttgatacctaaggcttgtagcataccgacaccaccgtcattggttgcactgccaccgatacccaaaataatttggctcacccctagctccaaggcggcgttaattagttctcctgtaccatagcttgtggtgtagtaaggattgcgtttttctatcggcaccaaatgtaaaccggaagccgccgccatttcaataattgcgatttttccatcacccgatatggcaaattcagcttgcgttttattacctagaggtgcggtaacctctacagaaatcagtttgccttgtagtgcatcggcaagagattggactgtgccttctcctccatctgccatgggaacttttacataatctgcattggggtagatttttttgaaaccattttcaatagcttgagccacttcaagtgcggttaaactttctttaaaagaatccggtgcaatgacaattttcattttagttctccttgatagtgattgattaaaataattgccatacaccaaaaatcagagtagagataattgtcatgatcaaacctactgcagtttcgtatgggattagttttaaccgctctttaatatccatattaacactaccgccggttgcatgaaagaaagaaccatgaggcatatgatcgaagacggttgcaccggcatgaatcattgcagccgctgcgataccgctgacgctcagttccattaaagttgctccgaacacttgagacgctacagcggttcctgctgtagtggaagctgtggctaatgacattaatcccccggaaatcggtgctaatagataagaaggtagtccggacgcagttaacccttcaattaagagttcttttaattcggaattagcgattacaccggctaatgttccggtacctaacaacatcacagcaacaggtgccattttacctaatcctatcactgcatattgatttaagtaacgtgttttattcatgcaaattgtgcctacaataccgccaagaggcagtgcgattaaaggatcaatttttatgccgaataatgggcgaagggcaagtaaaataatagtaaagagcggtgcaataatcgctggcaagaattttggtaattcgccagtgatcccaacgatttctttttcacttacttttgagcctttattcattaggcttttggctagaaaataggtgatgattagaccaaaaacagcaggaatgatgcccgctgtcatcactgaagttagagggatgttgaaggcatctgatgcagcgatagcatttgggttaggagacataatattacccgctttaccacccccaatcatggctaacaaaatagccattttggataaattgctacgttttgccaatgccagtgcaattggggcaactgtgatgactgcaacgtcaataaatacacctacagccgttaataacattgcggcaagaatgagtgccaacaatgatctggattcacccagtttttttacgatagtatcggcaatagtacttgccgcaccggattcaattaatacacctgccagcacaccagcggctaaaatcctcataacagcggtagtgataccttgtgctccgcctatcatcagcgtaactgtttggcttagatccgcacctccgattaaacctcccacaagtgcaccaataatcatgccataagcaggtgggacttttttcaaaatgagcacaattgcagtaaaaagggcaacaattgccccgagagcagttacagttatcatgatcgtttcctcatatattaataaaaaatcatgttgtgtattattgaatgtatgaggttaaaaaatcttcatatataaatacaaaaatacctgataaataggattattttttgtatatttatacaatttattggtttagcaatgtgcttaggtagagtgtaaatttttcatctatcttattgaaagacaagccggttattttctcaatcttgcttagacgataccttaatgtattgatatgaataaataattgttgtgaagtgagagcaagatcacaatttgaaaaaaaatactgttgcaatgttttttgtaacagatggttttcgtcttgttgatataaggtatcaataggttttaataactccttactttgccaagtactacgtaagttatctaataacgcaggcaatttatattgattaaagaaatagatggatttcttaggaaaataagtttccccataacgaagggtactaagtgcggtctgaaatgaaagtgaaatgttgcgattattttcaacttcggaaccgatagccactttcagcccttttaatcccgaaggtaatagataaggaggaaataatttctgtagtccttttgtaccaagtaaggcttgaagttcttcagcaggttgtataagtgcgattttatcatgcgataaggttgcgaagtggttaatcgattgttctaaatatccagcaagcttttgaagtttctctgctgtggggtgcaaaatttggataataatgaccgcacttttagtgtgtagcgttagtccgaaaaaagcactttgtttctcaatttctgcctcgttgagtttaccttttaataaacctagaataaactcttctttataacgtttatcccaacgttctttttctaacaaaaagtgttgttcaatcatcaattcagcagtcattttaaccatttcaccataggatcgaacagtgtcgggatctccggaaatacctacaacacctaaaatttctcccaaataactaatgggaagattaatgcccggttgcacttcaaataaccatttttcagctaactcctgatttatttctatagtttggttgtgacgaatagagtatatggcaccaatatgtctttgttgcaaacggtgaggattacttgaggcaataataatgccggtttcattcattacattgataggcttatgtagaacacggtttgttcgttgcacaatattttgagctaaagaaacgcttaatttcatgttcatagcaggacatttactgtaattatcaatagagtgactctcattttatgagaattttagacaaggtaaaagtataaaatttcagcaagtaaaaaatttttaaaaaaaattacttgcattgaaatataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggatgaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatgaccctgggtggagacactcagggttttttgttatttgggataaggcggggaagagagaagagagaagaggaaactgggagaaaaaaagtaataaggtgataacaaggtagtcataaaaagtagggtaatgaagcagagtgaagaggtgcggtaggaaaattgtttttttttctaccgctctttttgtaggtgatttatttatcgtttgccttattcatacgtccggcaaacaatatctttttcttcacaaaacatctcactatgctgtgcttgacactgtctttgtacattaagtttagctcggcctctgttgctatgctcactgcgatattcttgagtaaatggttttaatgtacaaacatgaatagcatcaaaatcagtttgttccgaaacaccgatgaaaattggaactggaatggctgtttgatcttttgttgatgtcggtacaacgcaacttgttaataatatacacaaaccgattaaacaaaaacgcatatttttctcctaaaaataaccttaatttcaaattttaagacgattttattatactcaatttttacaagaatgttcagagaaatgacaaaacatatagttttactttttctccataaaaatgtaggcatgatgtaattgaaactaagttgtatctcgtgtttaattaacattcatgccgatatcgaaaacatataagcaatatttgcttcgtttgttacaaattatttttcaattcgtaatccataagatttaaatttctctaatacaatctccatttcttttggagttaacaatgggatttctaaacctgtcgctaaaagtttcatgtaccattgtgccaagacttcaacttcatgagcaagccatagtgctttatcaagatttttctctgcagcaattaaaccgtgatgtgctaataaaattgctttatattttttaataccttgttttacatgctcagctaattcatgtgtaccaaaagttgcataaggaacacaaggaatatgatcagcaccgcctacggcaatcatgtaatgaaaaggaggaatgggtttttctaaaatagagacagctgcacaattgattgaatgattatgtacaactgcatcaacatcaggacgtgcttcatacacagctagatggaaatgccattcactggaggggaatttgccttcttcatgtttgccatgtttatctacataaacaatgttgttttcagtcagcaattcatatggcatgcctgtaggagtaattaacataccgtctttatatctgacactgacgttacccgcagttccttggtttaaaccaagtcttgtcatttctaaacaggtgaagataattttttttgaaagtagtgatctatccatttttattgtccttctatttcacaggtgtaacaccttttttaataataatattgccgtattttgcagtttcaccggtaataactactacataagcctgttttgctcgctcataaaaagcaaaacgatccattcttgctaatttaggcacattacctaccgcacttttaattgtttgaagatagctttgctccacagcgggatccaaactatccccttccactgcttgcatcataattaacggtgcctcagtataagtatcaaactcaaataaaggggcaatacctgtcagtaaagaattgatactaataccgtcagcacgaacaactttatgatgcaattgatgagctggaaaatgagcatcagataaaactaactcatctccatgtcccatttctgctaaaattttcaacaaatccggtgaaattgccggatgaatcccttttaacatatatcctcctgaagttttttataaaattccatatctgttgaaggctcaattcgtcggaatgtcggcttcattttttgctgtgcctcttcgacgtttgcaaaaacgcccgcaccggttaaagtaaacatagcggcacccaatactgtactctctgctatatcaataacatcaatagggcaacctaagacatcagcacgaatttggttccaaagtttatttttagatccaccgccaaccacaatcaaacgatccgcactaaaatttcccactttttgtaatacattcaagcctgcttttaaacggtaagccatgtattccaaacctgcacgataaatttcgccacgtttcgtatgcattgataaacctttgatttcacctgtttgttccattttgccgtcaaaatttcctacgagcttcacgccattggaaccggcaggtactgtttcgccctctgcgatcatagtttggtaatattgctctttggttacatcggaaaagaattgtttgcccaaccattcaatcacacccgaactaacccattgcactcccggattaaaagcatcaggcagactatcaaattctatggttaaaccatctctgacatattgccattgtgcttgagcttgctgtgttcttaccattaaaatttcccaagtacctgaacttaaaacaggttggttatatttggcaccggaaccgaaaatagcaaattgagtgtcatgtccacaggaaagtactgggatatgtgttgataaacctaaatattttgccaactcaggtaataaattacctattttttcacccgctcttttcatcggtgggaaatgttgttcgttcaaacctagaaaatctaaaacttctttatcccaagagtcattttctatatttgtcatcattgatgtacctgccatagtacgatctgtactaaattgacctgtcaaacgttgagttaatatagatgaaatgaatacccacttatccatctcggcaaaaatatccggtttattttctttcaaccacaataatttgaacaatgtattgaaactatattgtccaataccattacgctgatagagcttttttacatcaaggtattgatgaagtttctccatgacaggcaaagtgcggggacatttccaagaaattattggaaaaatttgcttcctatttttcgaaaaaggagcaccatctacaccaaaggtagtaataccaatccctttaatttcagctaaatcaatttgtttttggcgtagattcacaattgttttttctgcacaaaaaataagtttttggtagatttcttcgatgtcccaaatatgataaagagagttttcaggatcaggttgagtgtgattaggtgtatgatgtgatgcaacgattttacctgcttcatttattgcaatggtacgtaaatttgttgcaccacaatcaaaaatcaatgcaattgccataataactccataaaatcatgagcttattgcttaattaagaggggaaatttagtccttccccctccccttggatttcataaattaacgatataaaggaccaaagtttgcacaagcacggtaatcttgaccttctttatcttgaccaaatgcactccaagcacttggacggaaaatgtctttttcttcgacattgtgcatacagactggaatacgtagcatggaagcaagagtgatcaaatcagcaccaacatgtccataagttgcaacgcaatggtttgccccccaatttgccatgacagaataaacgtcagtaaatactcctgtacccgttaaacgtggaacaaaccaagtagttggccatgtttgatcagtacgtttatttaaaatatcatgcacgttttctggtaaagcaatagaccatccttcggcgatttgtaaaacaggcccaatacctttgactaagttaattctatgtatggtaaatggcatcccgcctttagttaaaaattgtgacgataaaccgcctcctctgaaatattcgtgtaccgccggacaccaacgagtattttctaagcaacgctttccatcttcttttgttacttcccataccggtttaatgactgatgttccgtttggatctgtatgttgtcccgtgccatccaaagcggcagagccggaatttagtaaatgaataaatccactttcaggacgccaacctgttacacgctcaacagaatcttcactccaataggtacgtacatcagcaaaaatttgagcctgaccggttagcaaattgccgaataacatgttaacgccatttaatgaatcattttctgtggctaaaatataaggaggacgtacaccgttccagtcataagttgaattcaatattgcttccataaagtcgccgttcggtagatgatctgtccaatggcgttgaccttggaaaccagcactaatcgcattatgtcccattgattcttctacataaccaagttcagctaaacgaggattaccaaccattagatctcgacaaataatcgtcattttgacaacattttcccaaagttttgcacgttcttccgaactacgctgattttcttcagcatttacatcaataccttctttacagtattgagttacccattccattgctaatttaacttctttttcatcatagattttgcgatctaaacggcgtttaatttcggtcatatctacatattcattacgcatatccaaatattcttgaaagaatgcttgattaacgatagaaccggcaatacccatagaaactgaacctatagataagtaagatttaccacgtaaagtcgcaactgcgagaccggcacgagcaaaacgtagtaatttctctttaacatctgttggaattgttgtatcagatgcttcttgaacttcagtaccgtaaatagagaatgcaggtagccccatttggttatgtccggcaagagccgctgccaaatacaccgcaccgggacgttctgtaccgttaaagccccaaattgcttttggcatatgaggatccatatcaattgtttcagaaccatagcaccagcaaggggttacagtgatgactgcaccgacattttcccgtttgaatttttcagcacatgcagcagcttcagcgacaccaccaatcgtggtgtccgcaattacacatttcacaaattgcccatttgtgtgccgcacttccgtttcaattaattgagccaccgcttttgccatattcatggtttgatcttctaaagattcacgaacgcccatacgacgtccatcaatagttggacggataccgatttttaccggtgttgattttaaatgtgtcattttttattccttcttgatgattaagtttattttttcacaaaaaacaacagaacatagttttttgtgtaatttgtaaaattttcgtgagataaatcacaaaaaaatccttttttgggttaaatttcttgtttttatttgcccgatttttaaatgattcatgatttttcgggcaaaacgatcaaatcaggcttcgaattatttcaataccttccaacttctatagccataaatagtaattggaataaagcagattaatggtagaacaaaagaaatgttcacagcaggcaaattaaaaatttcacctttatcaatgatcatgccttgtaaaggtggcattaatgcaccgcctacgattgccataactagacctgcggcaccaagacttgcctcttcttttaaaccgtataaggcaataccgtagattgttgggaacataagagacataaaacctgaggttaaaattaagcaatataatcctaattctccatcgataaaaattacgcctacaatgcttaagaaaccgccgataccaaataggcataacatcaactcagcttttaagtatttcataatactggtgctgataaagcgactggcaacaaaaattatcattgcaataatattaaaattttgtgcttcagatttagtaaaacctaagcgttcggcatattggataataaaggtccagcacataatttgaacacccacatagaaaacctgagcaattacaccttcacgatactttgcattttggattaggcgagaaaatgcgtctttgaatgcaattcttycccccccccctagctcttccatttttgtagtaggcattttgtataaactaatgactaacatgatgattaaaacaacacctccaacagctaaataaggattacgaataatttctaaatcatgggtgcgtatagtcgctttttctgcggtagataaggtattaaaaattagatttcccattgcatcacgtttttcagattctaggctggttaatactacttgtgatgccacaaacatacctgtaatcgaaccaagtgggttaaaagattgtgttaaatttaaacggcgggttgcggtttgcggatctcccatcgaaagaatatatgggttggctgtagtttctaaaaaagctaacccaaaagtcagaatataaagtgatagtaagaaaaaagtaaattcttcatacaaagctgccggatagaataagaatgcaccaactgcataaagggctaaacctaataagacaccggatttataattaaatcggctgacaaaaagtgcggctggaattgccattgttccatagcccccataaaaggcaaattgaacaagagcagcttctgatgctggaatttccataacagtttggaaaacggctaccattggattcgtaatatcatttgcaaatccccacaaagcaaacaaactggtaattaatataaaaggtgcaataaattgcttttcaagagttttagctgtcatttttctttccttaattatgagagtagtttcaaggattacattctcgtaaaattatgctgcgtgctttgcatcattttttgaaagaatgttaaaactattagaaaggaaaaatagaaagacaataagaaatttatgaaagtagttaaatttctgtgaaattcatcacaaaaaacgctaaaaaaattaaaagataatgcccgaattaaatcaattcttttgtaaatcgggcattattttgtttggataaagaggatttaaacaatagtgattaaaacatcagatttttggcagtatgatgtcaaagttggatttggaacttggtctgtaaataaaatatctatttgtgataaatctgttaaacgaatcaaatttctacgttcaaacttagaactgtctaataagagaaatttctgttcgcaagcatccattaatttacgtttaattgaggcattaagctcatttgattcccaaactccaccgctactatcaatgccggtgcaagagaaaatcccaatatcaatatgtaaacgttgtaataattgttcggataacggtccataaaaagcatcatatttcactgaataaacgccacccgttgcaatggttttaatattaggtttattaacaagtgcggtaatgttatgcatagaattggtcactactgtgcaaggaatatcggggatcatttgtgcaaaatgccagctggttgaactggcatccaaaccaagtacaataccttcaaacatatattcaatggcggaagcggctatggcacgttttttatcgcaattaaagcgttgtcggctttgaaaagaactcccgacatctttcgctttacggctgacagcacctccatgtacacgatgaattaaccctctcttatccagatcggttagatctcttcgaatagtttccacagatacgtcaaattgtttagctaaatcatttacattcacttttccggatgaatttattaattgcaaaatcaatgtttctcttgatgacatttcttttctccaagcagtcaagatggttacgaaagattacacgctaaacggtagtaagatcaactgttgaaaaattaccgcactttgccttaaatttattttactgtcattggtagtgttaatatgttcaagaagaattgcgtcagatcaggaaaagctgacttttcactttaaaatatactcattttttgctataaagtcggcagttttttacttaatacttaggagatattttatggagttagtatttattcgccatggttttagtgagtggaatgccaaaaacttgtttaccggctggcgtgatgtgaatttaacagaacgtggtattgaagaagctaaagcggcaggtaaaaaattacttgaagctggttatgaatttgatattgcatttacctcagttttaactcgggcaattaaaacctgcaatatcgtgttagaagaatctaaccaattatggattcctcaagtgaagcactggcgtttaaatgagcgtcattacggtgctttacaagggttggataaaaaagcaactgctgaacagtatggtgatgaacaagttcacatttggcgtcgttcttatgatgtttctccaccggatttagatccgcaagatccgaattctgcacataacgaccgccgttatgctcttttacctaaagacgttgtgccaaatgctgagaacttaaaaatcactcttgaacgtgttctgccattctgggaagatcaaattgcacccgcacttctttctggtaaacgtgtacttgtcactgcacacggtaactctttacgtgcattagcaaaacacattatcggtatttctgatgaagaaattatggcttttgaaattccaactggtcagccgttagtgttaaaactggatgaacagttaaattttgttgagaaattctatctataatttctttatatacctaatcaatggctgagggcatctcagcctttttgtatcactttttacattgatttgattttatcttgtcgcaattcctctttaatttctgtacaattggcagattttgtgtttattgagatattctatgagttcatccccaaatattggctttatcagccttggttgccccaaaaatttagttgattctgagcgtattttgaccgagttacgttctgatggttataatattatttccagttatgaaggggcggatttagttattgtcaatacctgtggctttattgatagtgcggtgcaggaatcattggaatctatcggagaagctttagagaataacggtaaagtgattgtaactggttgtttaggggcgaaagagaaccaaattcgtgaaattcatccgcaagtgctggagatcacaggtccgcatagctatgaagccgtgatgaaacatgtgcataaatatgtacctaaacctgaatacagtccttatactagtcttgtgccgaaacaagggataaaactgacgccaaaacattatgcttatttaaaaatttcggaaggttgtgatcatcgttgtactttttgtatcatcccttctatgcgaggtgatttagatagccgttccattgtgcatatactcgatgaagccaaacgccttgtagatgctggtgtgaaagagattttggtagtatctcaagatacctctgcttatgccttggataagaagaaagaaaatgccagtaaaacggtattctggaatgggatgccgattaaaaatgatctgattactttatgtgaaaaattaggttcgctcggtgcgtgggtgcggttgcattatgtttatccttatccgcacgtagacaatctcattccattgatggcagaaggtaaaatcttgccttatttggatatccccttacaacatgccagtcctaaaattttaaagatgatgaaacgtccgggttcaattgaacgtactttagagcgtatcaaaaaatggcgtgaaatttgtcctgatttaactttgcgttctacctttattgttggttttccgggagaaacggaggaagatttccagttattattggatttcttgcaagaagcacaacttgatcgtgttggttgttttaaattcagtcctgttgaaggtgcggtcgccaccgatatggaagatcaaataccggaagaaatcaaagaggaacggtttcaccgttttatgcagttgcaacaaaaaatttccgctgaacgtttacggcaaaaaattggtagaacattatctgtcattattgatgagattgacgaagaaggcattattggtcgtacgatggcagatgcaccggaaattgatggcgttgtttacgtagataatttttcaaaagtggaagtaaaactcggacaaattattaatgtaactattaccaacgcagatgaatatgatttatggggagagatttaagtgcagttaagtgcgggttgaattaccggaatatttattctccctcagaagcagtgatatattataaaattcaatttccaggatatgtatcatgttatttttacgacaaaaattcaaaaatagattaaaacttaccgcacttttttatgtagtttatttgctgttttcgtttgttgctcgtgccaatgaacttactcgcctccaagaaaaaattaagttacaagaacaaaaaattgcccaacaaaaaaatgaacaaaatgaattacaaaacgtattaaaaaaccaagaaaataaaattagtcaagcggaagataaattacgtcaaacagaagaaaatttgaaagaaacacaacaacttatcaatacaacagataaacagataaaacgcttggaaatgcagctcaaaagtcaaaaaaaactgcttgcagagcaaatagataaaatgtaccgagctgagattaattcttccgcagttgaaaagttgttttctcaagaggcacaaaaatctgaacgtatgcagatttattatcgtcagatgaatcaaactcgtttaaagttgattaatgaaatccaacaaactcaagaacagctggagaatgaaaaagcccttattcaaggaaaaagaaaaaatcagcaaaatcagctgacaacacaaaaacaacaacgacaagaactacaaaaattacagcgtgagcaacaattaatgcttgaacagctgaatcaaaatttagtaaaagatcaaaataagttggagcaattaaaggcaaatgaaattgccttgcgtcaacaaattcagcgagcggagaaaattactaaagagaaggaacagcgagagcgggcagcattggcacggaaaaaagagtcggaagaaaggaaaaaccgaaaaccttataaaccgacagcacaagaaaagcaacttatggcaagtaaaaaaggtttaggtgctgcaaaaaaacagtattcttttcctgtacagggtaaagttgtacaaggtttcggtacaagtcaaatgggagaattgaaatggaagggcatggtaatttctgcggtaaaaggttctccggtaaaagtaattgcagatggacgggttattttagtcagtcgtcttgcaggttatggtttaatggtaatcgttaaacatggagagcatgatctcaccctgtacggttacaatcaatctgctatggttgaagaaggacaatttgtgaaagccggacaaaaaattgctgaggttggtgatacggggagttatgcacttccggcactttattttgagattcgtcgtaaagggatacctgtcaacccgatgggttgggtaaaataaaatgagaagaaatatatgtattaaaagtgcggttaaaatcagtcttatggggctaatcctgagcattgtatcgtcttttatttatgctcaacataaactggcgattgtaattgatgatattggatatcgtcttaaggaagataatcagatttattctctgccaaaagaagtttctgttgccattattccttccgcacctcatgccaagcaacgtgatcaacaggcaaaacaacaagatagagatattttaattcatttgcctatgcaaccgcttaatctgcaaaaaattgaagacggtggaataaaattaggtatgtcgcaaccggaagtttatcatcgagtaagaaatgccaaaagtattttacccaatgctataggtatgaataatcacatgggaagtgcggcgacagcggataaagatttaatgaacaaattaatgaccgcacttttgcaacaagatttattctttcttgatagccgaaccattgggcgatcagttgcggggaaaatagcgagagagtttggtatacccactttggaacgtcatatttttcttgatgatagtgataaacttagtgatgttcaacgccaatggaatgcagccattcaatatgctcgtaaacggggaacggctattgtgattggacatccgagaaaaaatacgattgcagttttgcaaatggggataaaacaattaccaaaagatattcaattagtgggtattggcagtttgtggcgtaatgagaagataattcctcagaaaccttttatttatctgtttaatgatatacccgcaccgacatcgcaagcaccatttcaaactattcctttgttaagaggagtaccgaccgatatataatagaaaatacatgattgaagaataaacctctgaaggattttcagaggttggaagttaagggcgaatgtctcgtaagataggattttgcatagaaattaatgtttctgtagattgaatttcatcaattaattgaatttttgtagcaagaactgaatgaagttctgcaatagtatgggtcatgactttaatgaagatagaatagttaccggtcgtatagtatgcttcaactacttcattgatattctctaattgcttgataactttgtcgtaatctttagcactttttaaaataataccgataaagcaacatacatcataacctaatttacgttcatcaatgcggatttttgtgccttgaatgatgccggattgacgcattttttctactcgcacatggatagtgccgggactgacaccgaaatttttcgccatttctgcataaggtgtacgtgcatctttgattaatactcgtaagatttgctgatctaattggtctaaatttggcatatttatttttccttattattcagaattagaaaatatataaaaatattatgctatttttaatataaattcaatattaataaaaaaataaataaatggtattgaattagtggtgtgttttattaaataatacctaacgtgaatttaatattcaattactcgttattaattattaggatgtatgtcatgaaaaaatcatttattttacaacaacaagaaattagttttgctaaaaacacttttacagaaaaattaatcgaacatttaggcatcattgaagttcaaggacctatcttaagtcaagtgggaaatggtattcaagataatctttcaggtacagagaaagcggttcaagtaaatgtgaaacagatcactgatgccaaatttgaagtggtgcattcattggcaaaatggaaacgtcatacattagctcgttttaactttgcagagaatgaaggcttatttgtacatatgaaagcattacgtcccgatgaagatagtctggatcaaacccactctgtttatgttgatcaatgggattgggaaaaagttattccaacaggacgtcgcaaccttgcttatttaaaagaaactgtacgttcaatttatcaagctattttggaaacggaagatgcagtacaccaaaaatttgggttgagtaaatttttacctagagagattacttttatacacagtgaggaacttgttcaacgttatcctgaattgaacgataaacaacgtgaaaatgcgatttgtaaagaatatggtgcagtattcttaatgggaattgggggagtattatcagatggcaaaccacatgataagcgtgcacctgattatgatgactggacaacaccgtctgaaggtgagtatttaggtttgaatggtgatattcttgtttggaatcctgtattggagcgtgcatttgaagtatcttctatgggcattcgtgtagatgaaaccgcattacgtaaacaactggcattaaccggtgatgaagatcggttgcaatttgactggcatcaagatcttgtcaacggacgtttaccgctttctattggtggtgggattggtcaatctcgcttggcgatgttgcttttacagaaaaaacatattggcgaagtgcaatcaagtgtttggccaaaagttgttacagaacagtttgaaaacattctgtagcgtgcttttgaatattatattgaaaaagtgcggtaaaaataccgcacttttttatattaacgctggtgtattcttgatagaatgagcactcacttatgcttaataaaatataatttatgtataactcattttcttctttatttgaacaagttttgcagtctcccgattttatcattttaataaaaatgtctgttgctatgctattgggaggagcaattggcttggaacgagaattgaagcataaaccggttggtgtaaaaacttgtgtgattattgcggttacaacttgtattctgaccattgtgtcaattaaagctgcggaacattatgcacaagtttcagaaaatatccgaacagatccaatgcggttagcggcacaagtcattagtggcatcgggtttctaggtgcgggggtaattttacgtaaaagtaacgatgctatttcaggattgacaactgctgctattatttgggcagctgctggtattggtattgttgctggagccggcttcttttttgatgcttcagttgctacatttatgattttaatcgcagttcgggtaggtccgacgttacaacaaattatccgtcgcagtacacgtagaacacgtaaaactaaaatttatattcaacttagttcaccattgatcatcagtaacgttacggatattttaattaataataattaccgaattgatagtttatctgtcaaagatttacaaaatggagaagtgcgtttaaccattagaggattaatcacagataaatcgaaagtacaaggcgtttatttgttactaaaagatgaagaaggcgttgtcagtattgatttggctaattaaaagaaaaatccagatatttaattgatttgctccaaaagttgtactacatacaccatcaacaaattaaggggtagattttttatgatcaaagggaatagctccttaaaatttttacggtattatgtagcagttgcacaaagaccaaaattcattaaaaaaaaccgcttagaaatgaaatgccctaaactgatttttcagcctagggcatttgttatgacatattgtggctaatacggaaaactcacatcattgttatgctggtgatatttttgccaaaatgcgtgatattgttttttcaccgatgtgtttaataaaaacgggattatcaatacataggtcgggcaattccatagcattgcacgttgtgtatccgtgccgattttggtgcgtaagtaaccaaactgatacattagacccaatccaatcgttatccactctaatagcataataaataaagtcgcatcagtgagtgaaaccagtatcttatggtgtggtagccattgataaagtagcacgcccactactagcattattacggatagcataaaagtatgcctcacctttaactggtgacactggcagcagacagcacaaaaagctagagcatataacatcatcaaagaataaaataaaatcattgttaaccccccctttaatgtgtgttcatcatcgctttttgacctataaaagccctatctaaccaatacttatcgacttcattagagatgataggactctcaaatacttccattactgaatcaatatcctgaatctttttctgtacctgaaagtgagcgtaagccaaactaaagtaaggggttggctcaatttctttattctcgcccttttcatcgtaaggctgatgtaacaacatatcatttgaatcatcttgggattcaagtgattgaggtaatgtatcccacgaaatgccctcttcattcattactttcaacgctatcctatcggctaaggtaggttgattttctaataagcaggtaatcgggtcattggtatcataatcaaaacgaatgccatgaacatcaatcggtgtgatggttttcatcattataagatttcctttgtgttgagggtgattaaacagcaatgtgatagtctgctgcattttcgcttaaactggctattccaaaggtagcaggcggtcttttattgccttgccaataaccgacaaaatgccgtgagggcggacagcttaggcgtttgttgagtaattgggtaaatttctctttctcgcttttacggcgttcatcttcccgccaagcggtttcattcgcatagtgcatcatatagcggttgctgattcggtgatgaacccctgtcatcattcgcctaaatcgagcgaaaaacgattcggcaaggttgttggtgatgccgtctattgagcagtattcttgtgagtgattcactcgttctaaccgataatgaatgttgagcaggccataggcggcattttcatctgcacaaattacgctgttggctttcactaagtgatgcgtgagagcaagaatatcattgccattttcttccttaatcattgccacaatacttttatctgcacctttcattatggattgattggtggctcgttgacggaaaacgattacacacgccttgtctttacgttgattgcgtttggctcgtctatctatccgtctatgtttaaaattctttgggcgaatgtagtaattcacatagcagccatctgaatgtatctcacctgataagggagttaaatctttagtgagattgagcgactctcgcaatttatgtagcaatacccaagccgttttatattgcacattgagtttgtgagaaagcgaaatagccgataagcctgtgctttctgtggcaaacaaatacagagctatcaaaatctgacgtaatgagagtttatgaaattggaaaattgtgcctgtcgtaatcgaaaaacgagtgtggcaatgcttacattgccattgttggcgagtgttagtgaagtaggcggaatgacggacaccgcaatgaggacaaacttgttcatcttccgttccccagcgggcttttttgagtagagcctgtatttctgcatcagcaagcccaaccacttgtgtcagtgacaagtggcgagcgttcgcagataacaggaaatgctgtgccataaaaacaaaaatccctttattgccactctcaattttccaagcctttttagacttaaaaacaatcaaaagttgtaataaagggactattatccgtgccaaaaatgataatagtaacaggggtattgtcaagtgatactttcaagcaaaaattcaaaagtctgtcaagttatttttgatggaatataaaaaataaatttaaattattgatattaaattactattttgtgaaaaataatagagatttggggatttttgtgtgtttaattgatggttttttgttcaatctgattttcaaagattgtatgattattgagctattttgagtgattaggtggctaattctgaggggtatcttgctaaatatttaaggacaacgatagtaccgtttaccatcaataacaagcagattttggtttactaaatctttggtatagaaatgatagtaagcgaaatgattctgcggcataattcgagattcatttattttaaggatttaaaatgttcttgacactatttgctttacaattaacattgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcaacagaatagatctttacaaaaattcgttcaaagaattttttcaactttttgtatgggagtaaaatcctatgcagtctaatcaactctctttatttggtacgcaaccaaaaccaaaaatcctttctcttttttcaggctgtggaggtttggatcttggctttcaccaagctggttacgaaacagtttgggcgaacgacttttctcattgggcatgcgaaagtttccgtaaaaatatcggtgatgtaattgtagaaggtgatattgaacagattaacccaaatgatcctacgattcccgactgcgatattattcttggtggttttccgtgccaagacttttcgatgatttggaaacagcctggcctagatggcgagcgaggcaatctttacaagagctttttacgctttgtgaatgccaaaaaaccgaaagtgtttgtagcagaaaatgtgaaaggtttgctgacagcaaataagaaaaaagccattcaacaaattattactgattttgaaagctgcggttattacgttcaagctaagttgtataactttgccgaatttggcgtaccacaatttcgtgaacgtgtgctgattgtcggcgtacgtttagatactggctttaattttcaacacccaatgccaactcataatgcaagaggtgaaaatgggctaaaaccttacgttaccgcaggtcaagctgtttctaatattccaaacgatgcgatgaacaatgagctgatgaaaattagcgataaaactcgtcaaatgctgtcacttattcccgaggggggtaattttaccgatattccgaaagatcatcctttgtatgtgaaaggaatgattagccacgtttaccgccgtatgcatagagatgaaccatcaaaaaccattattgcagctggcggtggtggcacttggggctatcattttcctgagcctcgagcctttactaatcgtgaacgtgccagattgcaaagtttccctgatgattttgaatttattggctcagctactgaagttcgccgtcaaattggcaatgctgttccaccgcaaggcgtagtagagcttgcaaaagcaattttgcctattttctcggataattatgaaaaagtagatttacacgaaaaattggaaatagaaaaaacagaagtcttccaaaaccgtttaaataaaattcgtggaggaaaataatgaacaccgttttttctaatatcgccaatgcacgtattaccccaaaatctttaaataaagtttggacagatttatttatgtcgtctgatgaagtcctgatgacgactggttatgtttcaaatgatgcagtaaaagaattacacaaaattttggaacataatcaatctattcaaactgttaagctattggttggaatgcactatttagaaggttttagtcagcttcaatatgatagcttgtgtgaacttaatcaatttttgcagcaagaacagcgtggtgcggtttatgtttctccttttgttaaatttcacggcaaaatgtattcattcaaaaatagaaatgaaatacaaggtttaattggttcagcaaatttaacgtgtttttgggataaaacagaaagaacctatgaaactatgtttcatcttgaaaaactacctgcgatctcattaagaacagatattcaaacgacaatttctaaattggggaaacacttagaagaagctaaacgccccgatcattttagagatcataatattaatttagctcaatgtttaggtgtacaaaaggtctcgcctgaacatttggtttcttattttgaaaaaacatctcaatataaatttgaaattcctgcaaaaactgaacctaaaagtaatttaaatgtattctttggcgatccaagagtgggtagaaaagttttgccaagaccctggtatgaagtagaacttattattcctgcgacaattgttcggcaagagggttatccaacgaacagaaaaattcaagtgattaccgatgacggttggttatttccttgttattcaaaaccaaaaaataaaggtgaaaaattatcaacggaaaacttccgttccgaaaacgatctaaaaaccttaggaaaatggattaaaggaagattagaaagtgccaactgtttaaaaacaggcgaaaagatcactgaagaaactctacgaaaatacggtaatgatcattttgaatttcgttcaacggataatcccgatatttggttactttcatttaaggggaaaaactaaatgctgcaaacctatttaaatcaacttacaccacctgaattagctgattctataaaaaacaccgtttccggatttatggataaattggctcaaattgagctaaagaaagcccaaaatgttttattattaggcaatgtacaaagtggtaaaacagcccaagttttaggtgtattaagtgcattggctgacgatggcgatcataaaattttcctttatctgactactgatagtgtcgatttacagcagcaaaccgtaaaacgagctaaagcaagtttggataaatttatcgtcttatcagaagatgatgacaaaagttttactcaagtaatgaaagcagataatccgattttagtagttatcaagaaaaatgctagtgtgttaagacgttggcgaaacttatttaaaagccaagaaaatttaaaaggctaccctctagtgattgtggacgacgaagctgatgcggcaagcctcaatactaatgtaaataaacatgacaaagatgctagtacagtcaataaattattaaatgaaatcaaaaatagctgttgtcaaagtttatttattcaattaacggcaacgccacaatccttattgttgcagcacttggagtctaattggcagcctgattttattcatttctttgaaccaggtgagaaatatattggcggaaattttgttttttccgatccaccaagttatattttccgagcgattgacagcgaattagatgagattaaagatgatagtagcgatattccttatggtgttaaacaggcgttacaatcatttatgattacttgtgcagaatttgatttatgcaataaaactaactgtaattttgcattacacccaagttataaaatccaagatcataaagcatttgcagataaaattaaatcttgtttaaatgagttagtatacgccgtaaataatgatgaaaattttgcaaatagttttaaagaaagctatcaagatttacagaaaactaaacccaatattcatcactttgaagaaatctacgaaaacctgaccgcacttttgcaaaataaacgaattaatgttgttgtgctaaattctaaaactgaatctgattttgatttagaaaaagagtttaatatcgtgattggcggtaatgtgattgggcgtggtttaactattccaaaactgcaaacagtttattatagtcgtacagccaaaaagccaaatgcagatactttttggcagcattctcgcatttttggttatgatcgtgatacatctctgttaaggctttatatgccaacggatgtatataaattttttgtatcgcttaatcaagcaaataatttaattattgaacaagccaagcaattaaacggcaatgtacaaattatttatccgaaaaatatcaacccaacacgtaaaaatgtgttgaaatcagatgcaatcaatcaacttgttggcggtgtaaattattttccatttaagccaaatgaaaaaaatttagcccaaatcaacggattactttctgctattgagcaaaatccaattaaggaagatttatatcaaattgacagtgaaaccttatttttaattttagaaaacctaggtaattatcaatctgatgattgggataaagaaaaatttattaccagtattcaagccttaaaaactcaacgcccaagttttaataattatgttttaatcaaaaagggaagaaaaattggtagagctactggtacaatgctttctgaagatgatcgtaaattaggtgataaatatccaaacgatttgtttttaacactttaccttgtagttggtgatgaaaataaaggttggaaaggcaaagatttttggttgcctaacatcaaattgccacataaaggtttagtttattggggattaaaataacattatgccatctgaatgcaaattcagatggctttttactatattaaacattatcgatttttgaaatttctttaaaagaaatcgaaaaagcttctttgaggttttcaggcattgcacggtaggtatgcgatgagcttttcctcttgattagacatattttcttgggagatggtttggaacatcgtcccattcccagtcagtaaccaagtaatacttattccgaatgcttgacgaattttcaacaatgcttcaacattcggatctcgtccctcattaagataattcattgcagagcgatacgagattcccgtcacatttgagaactccgtcacagtcatatttttagcttcaagaacctgctttaaacgatttgatatgcacattatttcacatttctcttgttaaaagtgaatgattgtgatactttgtgcacaatcaatatgaatgatgtttcatattctagtttaatcaaggtttaactgcaatctcttatgtctcaacattttcttctttccagcaaagcccgcacgcttcgtcattacagatagcccgcctatctgatgacgaagggtttgcgatgctgtgtgaaattcattggggaagtcaggaaaatgtgtgctgcccgaaatgtggcgtacaacataaagcctattttattgccagccgtaagcagtggcgatgcaagcattgtaaccatacattcagcattacatcaggcacgatttttgctaatcgcaagaagtcgttacaaacctatctctacatcattgccaaattcgttaatgtcgccaaaggcatttcttcattacaactggcccgtgatgcgggagtcaattaccgcacggcgtttgttttgtcgcataaaatccgcaaagccttattagatacacgtgatttacagcccatatcagggggaagtcgatatggacagctcttatgtttaccccgctcctcgtaaagaaaataagaaatctgaccgcttggattatcgtttgaaagccaatcaacaccctgataaacgttgtgtgattgtcgctcgtgagcattattcggtaaaagtgtgagagtgtactgcattgcggagcaaaacgttcactggtaatggtggcaaaatccgaaacggagcctgtcgtcaatacgtttgcgaaccgctttattcaagccaatagccgtatcaataccgatgaaagctctgcctacgatgtgttattgccacgttacgatttacgcacggtcaatcacaaggaagaataccgtagcgatttagggataacaaataaccaagcggaaagcctgttcagtcgctttaagcgaatgtattacggacaagtgcataaaatgagtaatgcttatctgctcaattatgcgaatgaagtggcttaccgtgaggataaccgcagaaagccgaatggttggcagtttaatgatatcttagataaatgtttacataccactaatgaaaacaatgagtggtgtggttgttggcaacgcaaaatcgtgcatcaagaggtattgtggcaataatggcaaaatcggtctgcattaatcaaattgaacgtaaaatccgcttattcgagcgtgaacgtgagcaagttgtaaagcatttagcccttgtggacgataagctacaaaagctccgacacgcccttgaggtattagaacatcgccattccgccgataaatacaataccgcctattttacctataaattacatcaacgccatttcaaaggtaagctgcggaagatgttaatcgaagtattaaggcaagaaccaaaccgctattttaccgtgagcgaattgattagcttagtgctaattaaggacggtcaagcagatacccctatcacagctcaacataccgtatcaatgcgtggggcgttaaagcattggttggataaaggcgttgtagaacgccttgaaaagaatgtggtagaagtacgttggaagctgaaacaagaatagcgacatctgtctctattttgcttttcaccgccaatggcatttttcctcaatccaacctttctcaaccaatcctttctccattaaataccgcaataccgtataaaccgtttgggtttgtgggtttggcaaggtgtgtcctatcttttgtccgtctaatttcatcgctcggtgggtaatctcattcgtgttgagccatttatcaggctgtgatttcagtatattggcaactaatttttgtggggaagtaataaaacgagcatttctctctttcttaccagtggaaaatggcgtatttttggtatggttaagggcggtacgataatcagcgagtttttggtaaatatcttttaactgctgttcaagtaaggcgattttcttttcaagctcttcaccctcttgttctcattcagcaatcgctgctatcaaggcttttgataaaatagcctgagagtgtttcattgcgttttccttacctttaggttataacagataagaaaaatgtagcagaaacaaaaaggaaaatctttgtgcaactgctacataataccgaaattttatccttttcacttgagctttatttttaatctctgtataatcgccaaccttacagccatagttaattttcgttccttgcttccgcaagattggtggctggtcttataatcggaggctgattaacccgtaaggagcagtaatgcgtcactacgaaatcgtatttatggttcatccggaccaaagcgaacaagtacccggcatgattgaacgttatacaggttctgttaaagaagctggcggtcaaatccatcgcctagaagattggggtcgtcgccaattagcttacccaatcaataaattacataaagcacattatgtgcttatgaatgtagaagcgcctcaagaagtcatcgacgagctagaaacaactttccgttacaacgacgcagttcttcgtaacgtaattattcgtactaagcacgccgtaacagaagcgtccccaatggttaaagcacgcgatgagcgtaaacctttagctgaagttgaaaacaacgattttgaggatgctgaagagtaatttaactgttagtaatcgtttctctttagtcggtcaagtggcagattatccgaaacgatataaaagccctaacggtatcgaacattgccggttttatttggaacatcgttccgaacaacgagaagccgggttatcacgtcaggcgtggtgcaaaatagccatacaagttagcgggaatgcactaatagcaaaagctcaaagcattacggtcggtcagtaattattgattgtgggatttattaactcacataaatcggcaaacggtttaaatcaattagtattacacgccgagcaaatcgaatttatagattaggagaccagccaaatggcacgttatttccgtcgtcgtaagttctgccgtttcacagcggaaaatgtagtagaaatcgattataaagatattgctacattaaagaactatatcacagagagcggcaaaattgttccaagccgtattaccggtactcgtgcgaagtatcaacgtcaattagctcgcgctatcaaacgtgcgcgttatttagcgttacttccatacactgacaatcatcagtaatttaaggagaatacggtaatgcaagtaattcttttagataaaattgctcatctcggtaacgtaggtgatcaagttagcgttaaagcaggttttgctcgtaacttcttaattccacaaggtaaagcagttatggcaactcaagctaatattgaatattttgaaagtcgtcgtgctgaattagaacgtaaagcagcagaagttctagctacagcacaagctcgtgctaatcagttagcagaattggcaactgttactattacatctaaagccggtgatgaaggtcgtttattcggttctattaccgcacgtgatgttgctgaagcagtaactgcggcaggtgttgaaatcgctaaaagtgaagttcgcctttcaacaggaccacttcgcacgaccggcgaacaccaagtccgtttccaattacacggcgaagtatttgcaacattaaatgttgttattgttgcagagtaatcattaaaattataatgacagaacccaacttttatgttgggtttttttatatctttgttgccccaagtaatcttatagctaaattctttaactcatacattaatccacgtatttttctaacataacattattcatttctattttttatcctttatcctttatcctttatcctttgacaaccttagtagctttaattcaattataataacgcgctgttttcttactaactctttgagaaatagtaatctccgataattcctgtaatgatcatgggcttattgtaatctctgctgttgtgtatgggatattttaaaatctaaataatccgatacggtgtgccgtttcttttttgggtataatctgtcaatcttcttttactaaaggagattattgatgagtaaatcaaaagtaatatgaatccgatatatatggtgctacaataagtgcggtgcatggtgcatggtgcatggtgcatggtgcatggtgcatggtgcatgctttgatataatatattttgagtgaggaatttgcgatgtcctatttagaacgtgcaagagagctttttgatgaagcaaaagcagtgagaagacaaatccatcaacaccctgaagtgggttttgagttgcccgataccatggcgttgattaagaaaaaattggatgaacataatattcagtatcgtcaattggacgatgcctatgctctagtggggacgttgggcgatccgagtaagggtaagacgttgttgttgcgtgcggatatggacggcttgccgatggtcgaagaagcgaatttggaatttgccgccaaaaatcaatgtgcacatttgtgcggtcatgatattcatgcgacaagtttattggttgccctgatcatgctcaaagaagatgaagataagttgcaagggcaaatcaaatttttattccaacctgccgaagaaacgctgaatggtggtaagttgatgatcgaaaaaggggtgttggaaaacccaaaaccggatgctggtctagcactccatatgtggcctaatggtgaaaaaccagggattttgataaataaagaagctgcattggcatctgcattgaattttaaaatcgagattaagggcaaaggggcacacggtgcgatgccttataacggtgtcgatcctgtgtttgtggcttcgcaaattattaacggtgccaacggtattttggcacgtgagttgccttccagcaaaggggcttctttatccataggatcgatcagtgcaccgggcggggcaatcaatattgtgcctcctaatgcgtatttggaaggaacttcccgctcgttatacgatgattcggctaaacacatggcaaaacgattgcctgaaattgtcgagcatatcggtaaggcattcagagccgagacagtctatgaggaagtagcgaatgtgcctgcgttggtcaatacgcctaccatgtctgagttggtcaaggcgtcggcagaagaagcattaggttctgaatatacggtgaaatatattgatcctattttagcgtccgaagactatgcccatatcgccagtcaattgcctgaatcctgctatttctttgtgtcttgcccgcaaccggatgcggacggcaatgtctatgcggtacaccaccctaaagtggtcttcaatgaagaggcattgattatcggccctgcaactatggcacaagctgcggtgaactggttagcaagtcatcgttaagggggtgactcaatgagccagtgtggtgtgtattgaaatatcaatcccattggcttttttgtttttgaattaaaaatatttcattcaaagttttccgtcaatatccgctttgggatcccttgccatttaaaaaattaacccaagcggttttttttgcataaacagaaaaaagttgtagcaattattacatcaatatagacttgttccgattttaactcattgatattttagttaatctaaaaatttatggaaataaaatagccatgaaaacactcagtcaagccgctaaagtagtcacttttttacggcaaaatccacaacaaaaattcaccgctcgccaaattgccaaagcgattactgcgcaatatccgcacgattatcaagagaaaaaagccaactttacggatgaagggaaatttatgcaacaaattgtggcggaaattggttcacaaaaagatgccattttaaaacgttgccccgacattcaaatgcaggataaaccgcgtccgcgcttattttggtatgaaacaggaaattcaacaaaaggtgctttttctgaaaacacttttgttcaagtcaacgataaaaaaatctctgaacatgatgtgtatcctcaactcatgcaatttttatcacaagaattgaacttgtactgtttacggattgatgaaaaacgctctaaaaacaatcgtggccacaaaggtaatcaatggctacaccctgatattgtcgctatgcaagccttggataaacaatggacacaagatattcaagattgtgctaaattgggttcagggaaaaatgtggtattgtggtcgtttgaagtaaaatgcgaattaaacggtggaaatgtgcgtgaaagttttttccaagcggtcagcaattccagttgggcaaatgaaggctatttggtgaccaccgccattgttggtgaacacaccgaggaagaattgcggattttgtcggcattacacggcattggtgtgataattttgaatttagacgatttaaacgaaagcgaaattttattgcctgccaaacgcaaaaccgaaatagattggcaatctgctaatcgcattgtggaacaaaatacggattttaacaagtttattgaatacgttgccatttattataaaacaggcaaaattgttaaagagagttggaataaataaaacatgattaccaaacacaaccttcccgaattattaaaccatctcggttttaccgaacagaatcaaatctaccgcaaagtttttcatgggcaatatgaattaagcgtggatttcaaagcagaaaaaatccattatcccaatggtttaaccgccgaacgcgacaccacgctcaatttcagccagcctgaaaatttcgtggtgttggaatgcgtgtgccacttattgcaaacgagttacacgcccaatcaaatcgttttagagccgaaaatgacaggcggacgcgaagacaccagtttttattgcgatattttattgcgcgataacgaccacacgccctatatgttgattgaatgcaaaaccaccgacaacagcaacagcgaatttgaaaaagcatggcgcaaaatgcaaaaagacggtggtcaattgttcaattatttcaacagctaccgcaaagcacaatatttatgcttgtatgcttctgactggaatggcgaaaacgtagaacacagctaccgccttgtttccatgaaagacaacaccgaatatttaaaaagcgatgaaaaattgattggttatgagcaaattcacgcagaaagtggcagcaaaagcgatttctttgaagtttggaaaaacacttaccaactggacgcaacagaacatcaattatttgaatctgcaccatttaatatcggcacacgccccttttcagccagcgatttgaaagtggtggataacaccagcattcagaaaaaataccaccaattcgccaccattatgcgccaacacaatgtttcggggcgcgaaaatgcgtttgataaattggtgaatttgtttctcgccaaaatcaaagacgaaagcgaaaacccaaatgaattaaaagtttattggaaaggcgcggcacaagataattattttgacctgcaagaccgcctgcaagcactttacaaaaaaggcatggacgaatttttgggcgaagaaattacccacgttaccaaagaagaaattgaagccgcctttatcttattcaaaaacaaaaaagacgaaaccaagaaaaccattttggacaaattcaccgaaatcaaatattacaccaacaacgatttcgcctttttggacgtacataataaaaaactgtttttccaaaacggtgcaattttaaaagaagtggtacagatgctacaggacattcgcctaaaaaccgacaatggcggcgaaaatcaatttttgggcgatttgtttgaaggtttcctagaccaaggcgtgaagcagtcggaagggcaatttttcacgcctttgccgattgtgcgttttttggtgtcgtctttgcctttggcagatttgatttcaggcagcgatgcaccgccgaaaatgattgactatgcttgcggtgcggggcatttcttgaatgaatacgccagccaaattcgcccattggttcaagcatttaaacaagcggacaccgcaccttattatcaagccatcgtcggcattgaaaaagaataccgcctctccaaagtggcgaaagtttccgcgtttatgtatgggcaagacggcattcagattgtctatggcgatggtttgactgcacacaacgataaagtgaaagtggaaaatggtgcgttttcggtgctggtcgccaatccgccgtacagcgtgaaaggttttttggacacgctttcagacgatgagtgcaaatctttttcgctttacaaacatgtggataaaaccgatacctttaattccattgaaacttttttcattgaacgcaccgcacaattgctccaacaaaatggcgtggcggcgattattttgccgtcttctgtgttgagcaatggcaacatttacatcaaagcacgcgaaattttattgcaacactttgatattgtggcgattgccgaatttggttcaggcacattcggcaaaacaggcaccaataccgtaaccctgtttttgcgtcgcaaatcagacgcacccagcttgtccgcacattaccaaaaccgcgtggatttttggtttagcaatgacaagtccgccgatgaattgttccaagacgcacatttattgcagcaatattgccaacattgcggtttaaattggcaagattatcaagactttttgactttcaggctgcctgaaagcggtattttcgccgattaccgcgaaacttatcgccaaagcactgattggaaacaacgtcaagccaaacgcgattacaaagcactttccgatacggaaaaagcagatttgtttgaacaaagtgcgtgggcgtttgcgcgtgaaatggaaaaagacaaattgcattattttttattggcttatgccaatccgcagcctgtactcatcatcaaaagccccgccgacaacaaagaagcgaaaaaattcttgggctatgaatggagcacacgcaaaggcagcgaaggcatcaaatacatcggcagtagcgaagcggaaaacgaagaaaaccccaaccgcaatcaaggcattttcaaaatgcacacgccacttttcaatccgaatgatttgcatgactctagcaaactcaatcacttaatccgccaaaattttcaggccgcctgcacgcaaacgcagcctgaaatcagcgaagatttgcgcccatttgccagcttgcgtcctttgcatgaaatgctggatttttcgcgcacggtgtttgataaagccattcagacggcattggtggagaaagtggaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccattggatattcagcaacaaatcattgccgaatgccaaaaaattgaccaagaatacgaaaccagccgcatggcgattgaaacctatcgtgccaaaattgcccaaatattcagcgatttagaagtgctggcacaaaattcatcgaggggggggtaaaactgtttaaaatcaaagatttatgcaaaacaaatccttcaaaaaatattttgagggatttgcctgatgacttgattgtttcttttgtggaaatggcatcggtcagcaatgatggttacattcaacaaaaaattaaccgtccattgggcgaattgcgtaaaagcagctacacctatttccaagaaaatgacatcattattgccaaaataacgccttgcatggaaaacggtaaatgtgcattagcaacagaattgagcaatcacattggcatgggtagctcagaatttcatgttatccgctcccaatcaccaacattgaataatgcttttttattccattttttaaatcggaatgaaattcgtcaatcagcagaacaacatatgactggggctagcggtcatcgccgtgtaccaatcgggttttatgaaagtttgccagttcccgtgccaagtattgagaaacaaactgaaatcctcgcccaaatcgcgcaatacgaagcccaaatcgccacttgcgagcaaaaaatccaatctttgcccgctcaaaaacaggcaattttggtgcagtatttgcagtgatgtaactttcagacaacctgaaaaataaaggcaggtaaatatccgaaaatgacttaattctttacacgaccacagacattcaagcccaatttttgttatacgaattgggcgggtaattgtggctaacgcaagcataaattgccgaactggtcaaattaagaaaaaaacggcaaccctacctcatttcttcctgaaagtgcggtgttttttagcgataaaaatcatttcgttgattaaaaacttttcatgaagacaaaatatgtgattttttaaatgaaaaaatcgctatttgcaatgccgtttattgaatcaaatggttacatatcaatgctatcgttttttttgtttttgaatgtgaaataatgaagcgataatttgatttaatttatgtattgttatttaatatgcctatccgttggtaacggcgattattttattaagcatgacattacacttgctgtctacactgtcaataaaacacgtttatgtgatggtctggggagtattttatgtcttgtttttgtgtgttgttgtaatctgtatatgagttttttttggagtatctataatggaaccatcctaccaggaacaaaacaattgtactgaaacgattaaaatcaatgaagtcaaaaaactttggttggacagtaaattttcccttaatttacctgtatggacattgttgttgcctttatttgcattattagtattggcatttcatttgctgactcacccaacaggctggttgattaatactgttactacggttttgcttatcggttcggtatttgctgcagtgcattatgctgaagtgattgctcataaggtgggggagccgtttggtacgttggtgcttgcaatagcggtaaccgttattgaagtggcattaattgtgatcctgatgagtaacagcacgcaggaaaattctttggtgttggcaagagatacagtttatgcggcattaatgttgatttgtaatgggatcgtgggtatcgggctgctgataggcggtatgaaaaattatgtccaattatttagcttgcacggtattaaggctgctgtcagtgttttactggcaatttcattaattgtttttgtgttgcctaattttacgctttctgccgagggtggtggaatggtcaattcacagctgttgtttgtggcaatgtgctgtttggtactttacggctctttcatttttacgcaaactattcgccatcgtaattattttgttgatgaggatgaaaatgaaagccatcacaacgacaattggttaacaattggtgtgagtattgtgtttttattgataagtttagtttctgtggtaggactggctaaaatgctatcgcctactattgagtctgcactaattagtttcggattgcctaaaataatgttggggattatcgttgccggtttggtattgttgccggaatcaattgcttcaattaaggccgcctataataaccagttgcaaaacagtctgaatcttggtttgggttcggcattagcgtctatcgctttaactgtgcctgtgattgcgattatttctgttatctccggtcagcctattgtgtttggtttaacagccaaagaaagtttaatgctgattattacacttttattgacaatgaatactttaagcacaggacgtagcaactttttgttgggagttattcatttggtaatgttggcaacttttattttcttttccatcattccttgattttgaaatgaatgatttacatcagtaagtacgaagagaaaatcaatcacattattatcgggcagaaatatatgaaaaatagaaatttttattttggattgggttttattgctttgcttaccattatcgtgagttggttagcaaatactcaatttgcacatcaagcgaaaatcagtgctttgactatcgcaattttgttaggcattttaattggtaataccttttatcccgcactttcatcaaaactggacaaaggcgtgttatttgccaagggaacattgctacgtattggaattatattatatggcttccgtttgactttgcaggacattagccatgtgggaatcaatgccattgttacagacagtgttatgttgctttccacttttttccttgccgttgggataggaatttattggcttaaaatggacaagcagacggtgtatttgacggctggaggctgtagcatttgtggggcggcggctgtgatggcaatggaacctgttaccaaagccgaatctcataaagtatccgttgctgttgcggtcgttgttatttttggcacgattgccatgtttctatatccgtttgcctatttttatttacaacattggctaacagatcatcaatttgggatttatatcggttcaacggtacatgaagtagcacaagtttatgctgccggcggtaatattggtcctacggttgctgatacagcagtaatcaccaaaatgattagagtaatgatgttagcgccatttttattagttttatcttgggcattatcaaaacagaaatcagataaaagtaaaattaatattccttggtttgctttcttatttattctcatggcaatctttaattcctttgatattttgccaaaaagtgcggttaaatttattgtaaaattagacgatttactgttaattgccgcaatgatagctttaggattaaccactcatattagtgctatcaagaaagcgggtgtaaaacctttattattaggtatgttgctctttatttggttggttttaggaggattagcagtgaatttgttaatgcaaggatttttataaagataaggatattattttgaacaatcttactgaaacgtttactcttgaacctcaagataatgcacgcttacaatccctttgtggcacatttgatgagcatttgcaattaattgaaagcagttttaatttggttgtttcacgccgtaattttacttttactgtacaatccgcagacggagaagaaaaaaacacgtatcatccaactttgctaaaaagtgcggtgaaattaattaaaaatttatatgctgacactgcaaaaattcgtggcaaagtgaaagagctggatttggaagatatacatttggcaattcaagagagccgaatgttattacaagataatactcaaacaaagcgggaagatagtaaagtttatagcacaacaattaaaactaaacgtggcttaatcaaacctcgtggtaaaaaccaaattgaatatttacataatattctcacacacgatattagttttggtattggaccggctggaacagggaaaacttttttagccgttgccgcagcggttgaagcattagagcgtcaagaagtgcgtcgtattttgcttacacgtcctgctgttgaagccggtgaaaaattgggttttttacccggtgatttaggacagaaaattgaaccttatttacgtccgctttatgatgctttatttgaaatgttagggtttgagcgtgtgcaaaaattaatagaacgtaatgtaattgaaattgcaccgttagcttatatgcggggacgaacgttaaacgacagttttattattttagatgaaagtcaaaacacaacggttgaacaaatgaaaatgtttttaacccgaattggatttaattctaaggttgttgtaaccggtgatgttacgcaaattgacttacctcgtagtcaaaaatccggtcttcgccatgcgattgaagtattagaaaatgtgccagaattaagttttaactattttgacagcaaagatattgtacgtcatcctgttgtggcaaaagttgttcaagcttatgaggtttgggaaattaaagatgagtttcgtcgccaacaattagccgagcaaaaacaacaagagcggttagaaaaagagcagtttaccgaagaacgggtaaaagcgttacaagaataattttatacaaaggttcaattcatgaaaaatgtcattattgacctacagatagcgagcgaagatgcgaccaatttaccaagtgtggaacaaattcaactatgggcaaatgcggcaattcgagcggaaaactcacaacctgaaatgacagtacgcattgttgatgaagaagaaagtcaccatttgaatttaacctatcgtggtaaagataagccgactaatgtgctttcttttccttttgaatgtcctgatgaaattgaattaccattaattggtgatctagtgatttgtcgtcaagtagtagaacgagaggcgacagagcaagaaaaaccactaatggcacattgggcacatatgatcgtacatggtagtttacatttgttaggctatgatcatattgaagatgatgaggcggaagaaatggaaaggttagaaacggaaattatgctttcgttaggttttactgatccttatattattgagaaataaccaacctgaaatgatatcttctcgccatgtgcaaattagtattgcacccaatctgcaaggttttggaccgcactttttatcacattttgatgttttgtggttagggtgggaaaaacccgattttaatgtgcatttttgccatgtgcaaaaagcaaaaaagttacttgggcaagagtttttaaatgtgatttttgatgctcgtcagggatttcatttagaaagtttggcgattgtggcgggaacgataaaagcaggtggaacattaaatattctacttaatcattgggatcttttagaacaacaggctgatgttgatagcttgcgttggagcggtgtagaagaaatgattgcaacaccgcactttattcggcattttcaacggattgttaatcaatttcagtttcctgttaatcatttcgctattccagcgattactcaaaataacctatctgatttattttgttcagttcaattgagtgcaactaaagcacagcaaaaagttattgacagtattttacagcaacaggcagatatttattttttaacagcaaaacgtggacgaggcaaatcagcattattgggtttgttatctcaacaagtaaaacagaaagtttatttgacggcaccgaataaaagtgcggtgaatattttgcaaaagttcgccggtcaatcagttacttttattgcacctgatgagtttgttcaccgtttggtagaaaatccgcaagaatatcaacatgcttggctatttgtagatgaagcagccatgctacctgtcagtaccttaaatttttttagtgcttattttaaacatattgtttttagtacaaccattcatagttacgaaggtacggggcgtggttttggcttaaaatttaagcaacgaattttacaacaacggcgaaaatgtcttgaatttgaattaaaggagccattgcgttggcgtgaggatgacaagttagaaccttttattgatgtgcttttattgcttaatagcgaagatgattttcggcaatatcattacaaatccaatttggacgttcacataaaatcgctaaatcaacaggcgttattgacacaaatagcagatttttacggtctattatctttagcacattaccgcacttctcctattgatttacgtcgtttattggatgctccaaaacaacgattttatttggcacagacagaaggacatttgctcggtggaatatgggcattagaggaggggggattgacagatcgaggattgattgcggcgatttgtcgaggagaacgccgaccgaaagggaatttagcagcacaattattggcttttcaatatcttaattcacaggcttgtgaattacgttctttacgaatttctcgcattgcacttcaacctaattggcagagaaggggagtagggcgagatttgatagctgctttgaaagtagaaagtaacattgattttttatcagtgagctttggttacagctcggagttggtttctttttggcataagtgcggttttaatttagtgtatttgagtgagtataaagaaagtagcagtggcacatataatgcaatggctatttgtcctttgactttgcgaggcaaagaattttcacaacaatgtatgagtcaatttagacgagattttgttttatcggatcatcctttattgaatgagattataaataatcaaactattgaggtagagttaaatgcctttgatgtatactcattgcaaaattttgcattttattaccgcactttatcggctgctcgtcctgccttatggagactattgaagatgatagctccctctgattgtcctgtcttgaggaaatatttttgtggtgaaaaagatttcttgtcttatggcggttatcgacaaggagtgataatttgccgcaacgaagtaaaagaagtgttgcaaaaatataaaaactttctatgatggagtgatttttatacaggaaggagaatgtgatgccggatcaatcagaaaagaaaggttttttccgccgtatgctggatgcgtacaatcaattttgtaatgaaatggaggtggataaagggacttgtcgaggctgtgtacctatagtcaaatttgatgaaaatgcaaaacaagaaacagataatgaggctggtaaagcatcataattgtgaagtacttcacataatggaaaagatttagccaaccaatgtatccatcttagtttacttaactataacaactctctaaaatacgcacgctttacttcagtgaagttggcgtatttttattattatttttaggtgattattatgttatggtttttcttttgtgttgccctattgattttaggctatttcacatacggtaaatttgttgagaaagtatttgttatcaatccgaacaagaaaacgcccgcttattctatgacagatggtgttgactatgttccgatgtctaaaaagaaaatttggctaattcaattattgaatatcgcaggcacaggtccgattttcggaccgattatgggggcattatatggaccggtggcgatgttatggattgtactgggttgtgtatttgccggtgcagtacatgattatttctgtggtatgttgagcgttcgtaatggtggtgcttcaatgcctactcttgccggacgctatttaggtactcccgttaaagtatttattaacgtacttgccgttgttttattattccttgtcgggattgtgtttgtaaccagtcctgctcagttattaagtactattactttagatatgtttggtagtgcaagtatggctacaaccaatgcacatgaggtggtaagtgcggtacaaaacgctggtgagatccgtgtttggggaatggataaaccgacagttgtggcggtttggactggaattattttcctttactatattgtggcgacattgttaccgattgataagattattggacgtatttatccattatttggtggattattattattcatgtctgccggtatggtatatggcttagtatccagccatttaaatggtgctgatccaattgaatttttccgttccgttgatggtatgagttttgaaaaattcttacaaaactttgaaactcgtaaagagctaccattatggccattattattcttaaccatttcttgtggtgcactttccggtttccatgcaactcaatctccattgatggcacgttgtgctgaaaatgagaaagaaggtcgttttattttctacggagccatgattgcagaaggtgttattgctttagtttggtgtactgttggtttaagtttctatgaaaatttgggtgaactattagctgcaacccaacaaggttcaccttccaaagtagtgtatgattcttctatttatttcttagggactattggtggtgtttttgctgtattaggggtagttgtgctacctattacttccggagatacagcattccgttccgctcgtttgattattgcggagttcttaaaaattgaacaacgcactttggtgaaacggctacttattgcagttccgttatttgcagtcggtttttggattattgcatcaaaaattgactttggtgtgttgtggcgttatttcacttgggcaaaccaagcaacagcaatggtgatgctatggacagctgcggcttatctatatcgttacaataaattccattgggtgtgtactattccggcagcgtttattagtgcggtatgttttacatacttagcctataacaaaattggttttggtttagattatcaactttccgtttatattggtattggattaactattttgtgtttagtggctttctttactttattgaaaccgttaggttcgaaagatccggatgcctttataaatgatgtagcataattcataagtaatagataaaaaaccgttcgaggcaacttgaacggtttttttataaaaaatttactttatttatatgttttcaagataaaaaacttgcaacctaatctcactggtaatacacttatgaagtggtaaaaagtggaattttgtggagaaatttgtcataatcttcctcatttatctgcgatcaataattttttgtgattaaagtaaggaaacaatatgtttcgaggggcatcagcggttaatcttgattctaaggggaggattgcaattcctactcgctatcgtccggaaatcctcgaaataaatcaggggcagatggtttgtaccgttgatattcgccagccttgcttattactttaccctttaaaccaatgggaaattattgagcataaattatcaaaattgtcgaatttcaatccggaagagcgtagtttgcaacgtgtaatgctaggttatgcaactgaatgtgaacttgacagtgccggacgaattcttattagtgctcctttacgtcaacatgcaaaattagaaaaatccattatgttggtggggcaattaaataaatttgaaatttggagcgagtcagagtggcaagctcaaattgaaaaagatatgacattaggtgcgagtggacaatttgccatgtctgaagcattaagtatgttatccctataataaaaaagatacgttacagtcagtaacggtactagcaaaggtaaaaaggtacgttttttgttgtaccttttatcccttttgattttattgatttttcctaggttattgcaaatgagtatgcaagatacattttcttcacctgagcatttcactgttttattaagagaagcagttggcggtttagccttaaaagaaaatggtatctatattgatgggactttcggtcgaggcggtcattctcgttttatcctttctcaactgtcaaaaaagggccaattaattgcgattgatcgtgatccccaagcaattcaggttgcacaaaatattcaagatccacgttttcgtattgtgcatgacagcttttcagctattccggatatttgtgaaaaattaggattgacgggcaaaattgacgggattttacttgatcttggcgtgtcatctccacaacttgataatgcggaaaggggattcagtttcatgaaagatggtcctttggatatgcgtatggatacgacacaaggattatcggcaacggaatggttgaggcaggtttctgaacaggatttagcatgggtattgaaaactttcggtgaagaacgctttgccaaacgtatagctcaggcgattataggatataacaaaagtgcggtgcaaagtggagcagaacctttaaacagaactttacaattagctgaactgattgctcagtctgtaccttttaaagataagtataagcatcctgcaacgagaagttttcaagctattcgtatttttattaattcagaattagatgaattagaaaaagtattgaatggagctttaaatgttctcgctccccgaggacgcttgtcgattatcagctttcattctctggaagatcgtatggtaaagcattttatacgtaagcaaagcaaaggtgatgatgtacccaaaggattaccgttgcgtgacgatcaaattcaacataatcaaaaattaaaacctattggtaaagcgattatgccgacagaacaagaaatggctgctaatgttcgttcaagaagtgcggtcttacgcattgcggagagaatataatggtaagagatttcgaacgctacccattgtataaagttatttttgaggacttggtttctgcaaataaattattaattgttttaacgattttggttgtattgagtgcgttaagtacagtttggattactcatcaaactcgtattttagtcgctaaaaaaagtaatttagttgttgaaaatcaatcacttgagcaagaatatttaaatttaagattagaggaaaaggcccatagtcttcattccgatatagagtcttttgccactcaaaagttgaagatgaaatccgttccggctgaacaagaggttgttatcattgaatagataatagatattaggcggttattaatgacacataataagataaatcgaaaaaacaaacgagcatttgaaaatggtgcaaagcgtaatcaacctaaaaagatctatgaaaatagtttcttgaaatggcgttttatggttgttgttggtcttattattttatcactcacagctttagtgggacgtgctacttatgtacagatgattaaatccgatgtgctatctaatgaggcggatgaacgatccttgcgtaaagaaaaaattttgtctatgcgaggtaccattgttgatcgcaatgggcaacttttatcagtgagtgttcctatgttttcaatttcagctgaaccaaaaaaaatttttagtaaaaatggtttacaagatgaggaacgctggcgtgcattagctaaagcattaggtatgtcttacaaggacttacgaaaaattctagaaaaaaatcctaaatctagttttgtctatttagctcgtcaggtgtcaccaaccattgcggagtatgttaaagaattaaatctatatggagttaacttaaaaactgaacctcgtcgtttttatcctaagacagaggaaactgcacatttactcggctataccaatatagacggggaaggtattgaggggatagagaaaagttttaattcatttttagttggtaaacctggatcaagaacagttcgcaaggataggcatggtaggattattgagaatatatcagatcttaagaaatacgatccgcaaaatgtcattttaagtattgatgaaaaattacagtccgtagcttatcgtgaaataaagaaagctgttgaaaaatacaaagcggaatcaggaacggcagtacttgttgatattcatacgggagaggtgttggctatggctaatgcaccttcttataatccaaatatacgcacaagttttaagactgaagtgatgcgtaatagagctattacagatactttcgagccaggttcgactattaaaccttttgttattttgaccgcacttgaaaaaaaagtagtgcgaagagatgagataatcgacactggtcgtttagttttagatgggtatgaagttaaagatgttgcagtcagagatcgccaaacgcttgatcaaattttagaaaattcgagtaatagaggggtgagccgtttggctttgcgtatgcctgcaaatgcactaatagatacatataaaaaagcaggtttagggcaacgaacagaattaggtttagttggggaacaggcaggtttcttgaatgccgatcgtaagaaatggtcagatattgatagagccagtgtttcctttggttatggcatcagcactacgccgttacaacttgctcgtgcctatgttaccttgggcagtttcggtatttatagacctctttcaattacaaaagtagatcctcctgttattgggcagcgagtgttttctgaaaaaatgactcgtgaagtggttaatatgatggagaaagttgcgataaaaaataaaagagcaatggtagagggttatcgagtgggaataaaaacaggaacagcaaagaaaattgaaaatgggaaatatgttaacaaatatattgcttatacagccggacttgctccaatcagcaaccctcgctatgccttagtggtattaattaatgatcctaaaggtagagaatattatggtggggttgtttctgcccctgtattttccaatattatgagttatgctttgaaagcaaataatattcctcctgatagtagtaactatacaaaaactgttagacgtacagtttatctcaatagtcaagagaataaagcgaacgccaattaatcattcaggtaatctatgaaaaaattaaccgcactttgggatattgatgaacaattagatagcgttcatagagatattgaacttcaagaaatgattttagacagccgtttagccaagaccggctgtctttttgttgcgattaaaggacatcgtgttgacggtcgagaatttattatgcaagccattcaaaatggagcaagtgcggtgctgtttgaaactgatctagtggagcagcatttgaaagtaagctttgagcaaaatattccgcttattgcgtattatgaactgtcaaaacatctttctcatattgcagatagattttattcatctccttcacaacgtttaacccttgttggcgtaacgggaaccaatggtaaaacaaccatagctcagttacttgcacagtggacacaaattttagggcatacaagtgcggtcatggggacgattggcaatggtttatttggacaaataaaagaagcttcaaatacaacgggatcggcaatagaaatacaatcctcgttagataaatttattcggcaaggtgctgattttgctgcgattgaagtgtcttctcacgggttagtgcagcatagagttgaggcactgacttttcgtgcaggcatttttaccaacctaagccgtgatcatcttgattatcatcataccatggaaaattacgcacaagcgaagaaacgtttgtttagtgaactgaattgtcaacataaaattttaaatgttgatgatgaaatcggggcaacatggttgattgaattaagtaaagatgatcctgatgtggttgcagtaagttgccgtgcggattatcagcccgatacaaaaaattggctaaaagcaaccgcacttagttttcacagcaaaggcacaacgattgaatttgcctcaagctggggaaatgggatcttaagtagcccattaattgggggcttcaatgtgagtaatttattacttgttttagccacactcttatcgcttgggtatgacatagataaattacttgctacagtacggcaattaaccggtgtttgcggtcgaatggaaatgttgagtgcaaaacataaggctaccgtgattgttgattatgcacatacaccggatgctttagagaacgctttgcaatctgctgcagttcattgtcagggaaaactttggtgtattttcggttgtggcggtgatcgtgatagaggtaaacgtccattaatggcagctattgccgaaaaatttgctgatagtgtgattgttactgatgataatcctcgaacagagaatcctgaacaaattatgcaagatattttgacaggttttcagcaatcaagtgcggtgcagattattcatcagcgtgagcaagcaattaaaacagcgttacaaagtgcggtagaaaatgatgttgttttgattgctggaaaaggtcatgagaattatcaaattattggaacaactaaataccatttttcggatcaggaaattgtaaaaaagtatttttaagtttagtaaaatttgaagtcattgatgagtaaaatacagaaataattcattgtattgaatgatgagaagtaagaaataacatgattaagttatcgacaaaagaactggctgacattttttccgcacgattaattggagcggaggatatttgtgtggaaaaggttagtaccgacacaagaaagccttgtttaagaagtttgttctttgctttgaaaggtgaaaattttgatgctcatgattatctgacacaggcagtagaacaaggttgttcagctgttgtagttgagcgtgagtgtgatgttgatgtaccacagttaattgtacctgatactcgtcttgctttagggcaattagctaaatggctaagagtaaaaattaatccaaaaacaatcgcaataacgggatcttcaggcaaaacaactgtcaaagaaatgacagcttctattttgcaaaaagtggcacaagatcctgatgcggtcttatttactcagggcaattttaataatgatatcggtgtgcctttgaccttgttacgtcttgagtcgaagcataagtttgctgttattgagttaggtgcaaatcatcaaggtgaaattgcttataccgtggatttagttcaaccggatgtggcattggttaataatgttgctgcggctcacttagagggatttggaagtgttgagggagtggcacaggcaaaaggcgaaatctatcaagggttaagtgaaaacggcattgccataatggaatatgagcattctgtactctggaaaaaatattggtatgaacaaataggtaatgcagatactcgattgttttccgttatggggaaggtgtcggattactatgcacaagaaatcaaattaacggaaacaggcagtcagtttacattgtgttgtaccgagcaaggagaaattaagattaatctgccttatttaggattacataatgtcagtaatgccgtagcggcagcctcattagcttcatgcttaggtgtgagtttagaacaaatcaaagcaggcttagaaaaaaaatcgtatgtaaaagggcgtttatttcccattgagccttgtccaaatctattgttattagatgatacttataatgctaatgtaagttcattgaaatccgctattgatgtattgcgacaatatgataaatttttccgtatttttgctgttggtgatatggcggaattgggggaaaattcagtgagttgtcacaaacaagtagcggattttgctcagatggcgaacttagatttagtggtcagttttggtacacaaagtgcggtcatttccgatgcttgtgatggcgttcattttagtgataaaaccgagttagtgaattatataatccccattattcagcaaaaattagccggtcaaaaagttgttttattagtcaaaggggcgagatgtatgcaaatggaagacgtgattaatttagtaaaggataaatttcaatgttagtgtggttagctgaatatttacaccaatatcaaagtgtatttaatgttttttcttacttgacagtgcgtgcaattcttgcacttttcaccgcacttttactctcgctatggattggtcctaaagtgattcgtcgtttacaaattttgaaatttgggcaagaaatacgtaatgatggtcctgatagtcacttaagcaaaaaaggcaccccaacgatgggcggtattatgattttatttgctataggggtcagtacgttattatgggcaaatttagccaatccttatgtttggttttgcttgtttgtattatttggctatggtgcggtcggttttgttgatgattatcgtaaaattacacgcaaaaatactgccggtttagttgctcgttggaaatatttttggctttctgttatcgctttagtctctgctttcggtatgtatgcgataggtaaagatacggatgcgacacggttggttgtgcctttttttaaagatgtcatgcctcagttaggtttgttttatattgtattggcatattttgttattgtgggcaccggcaatgcggttaatttgaccgatgggctggatggcttggctattatgccgacagtttttgttgctgctgcatttgcgttgattgcatgggcgaccggaaatattgaatggtcaaaatatttatatattccctatattaaacatacctctgaattggttatattttgtactgcaattgtgggtgccggtttgggttttttgtggttcaatacgtatcccgcacaactttttatgggggatgttggttcattagcattgggtggagtattaggtactattgccgttttagttcgacaagaatttttattggtgattatgggcggtgtatttgtcgttgaaactttatcggttattttgcaagtaggatcttataagttacgcaatggtaaacgtattttccgaatggcaccaatccatcaccattatgagctgaaaggttggccagagccacgagtaattatccgcttttggattatttcgctgatgttagtgttactcggattaattaccttgaaattacgttaaggcaagctatgactaatcaatatcaaaacaaaaatatctgcgtagtcggattaggtaaaacaggattgtcttgcgttgatttcttgttacggcagcaagcaaatgtacatgtcattgatactcgtcaacaaccgacgggagcagaaaaattacctgaaaatgtccccttacatacaggaagcttaaaccaacaatggctacttgaagctgatctcattgtgattagccctgggctttctgttaaaacacttgaaattcagaccgcacttcaggccggtgtagaggttgtcggtgatattgaattattttgtcgttacgccaataagccaattattgctattacaggctcaaatggtaagagtaccgtgactacattggtcagtgaaatggcgaaagaggatggcttaaaagttggaatggggggaaatattggtattcctgctcttgagttattgcaacaagattatgatctctatgttttagagctatcaagttttcaactggagacgacttatagtttgaaagcgacagccgcaacgattttaaatattagtgaagatcatatggatcgttatctcgatattgaagattatcgccaagccaaattgagaatttatgaaaattgtcaacgtgcggtaataaatgccgaagatgtattaacaacaacggaagatttaaagtctccaattacttttggagaaagtcaggctgattattggctaaaaacggaaaatggcaagcaatatttaatggcaaaagagcggttaattttaccttgtgatgaaatgaaattggtaggtcgtcataattatatgaatgcgttggcggccagtgcgttggttcaggctgtcgacataagttttactgcaattcggaccgcacttcgtaaatttaccggtttagctcatcgctttcagttagcatatcagaaagatgatgtacgttggattaatgattcgaaggcaaccaatgttggaagtacagttgctgcactgaccggtttgtatgtagctaataaattacatttattgttggggggggatggtaaatccgcagatttttcggaattggcaacattaattaatcaaccccatatttattgctattgttttgggcaagatggtaaagaacttgccgcactatcagtgcaaagtcagttatttgatacgatggaacaggcaatagaagctattcgtccgaatttacagcaaggtgatatggtgcttttatcaccggcttgtgcaagtttggatcaatttaaatcctttgaacatcgaggtgatgtttttagtgatttagcgaagttggcacagggttaaagatagagacaaaatgggacaaaataacgtaaaacaacatattgatcgttggttgcgtattacaccaacaacagcattatatgatcgagcattgctatggttgtttattattctattgtgcttgggattaattagtgtatcttccgcatctattccaatcagtacaagattatttaatgaacctttttactttataaaacgtgatataggatatatttttatctcgttaattgcttttgcgtttgttgttctcataccaatgagaatgtggcaaaaatataacgttatattattttggattgctgtgattttattattgctggtgcttactggaatcggaaaagatgcaaacggtgcaaagcgttggattccgttacaactatttaattttcaaccggctgaatttgccaaattagcactaacgtgttatttggcagattatttcacacgccgttataatgatgtacgtagcaaaaaattaagtgcatttaagccattttttgtcatggctatattgggtggattattattgttacagcctgatttagggagtgcggttgttttatttgttataacttttggcttgctttttattgtcggtgcaaatttttggcagtttgtagggttgggaggaatcgcttttttcttattcctatggttagtcgcatctgcctcttatcgtttaaaacgctttacaggttttcttgagccttttaaagatcctctaggagcaggttatcaattaacaaactctttaatggcttttgggcgaggtgagttatggggcgaaggattgggaaactctgtacaaaaattggaatatttgcctgaggcacataccgattttgtcatggcgattgtcggtgaggaatttgggcttgtaggcattattgtggtggtgttcttacttgcgttactcgtttttagagtaatgaaaatagggagagagtcattattattagaagaacgctttaaagggtttttggcttttggtataggtttttggatattttttcaaggatttgtaaatctcggtatggcattaggcatgttaccgaccaaaggattaacctttccattagtgagttatggcggttcaagcttgctgattatgtcagtcagtattgcaattttgttgcggatagattacgaaaatagagttgttcgagttggaagtgctcgactaagagatgattaaaataaggaaaataccgtgtcaaaaagaaaaaaattattggttatggctggcggaaccggaggtcatgttttccctgctattgctgttgcacaatatttacaaaagcaagattgggatatttgttggttaggcactcgggaccgtatggaagcaaagttggtgccaaagcacgggattccaattgagtttattcagatttccggtttaagaggcaagggattaataactttattgaaagcaccttttgtcattttaagagcggttctacaagcgagaaaaatcataaagaaatatcaaccggatgtggtactcggcatgggaggatatgtctctggacctggtggagttgccgcaaaactttgtaacatacctgtagttgtgcatgaacaaaatgctgtattaggtttaacgaattcattgctggctaaaattgcgacacgggtattacaagcatttccaaatacatttcctaacgcagaagtcgttggtaatccggtgcgtgaggcgtttttttctgtgcctatgccacaagaacgttttaacactgcttgtgagacactcaaagttttagtggttggaggaagtcaaggggctcatatattgaatacaatattaccggaagtattagctcaattgcctaatcgtctggaaattgttcaccaagtcggatcaggttcggtggaaaacgtcaccgcactttatcatgataaagttaatcttacgcaagaatcagtacaaattaccgaatttattgatgatatagctcaggcttatgcttgggcggatatcgtcatctgccgttccggagcattgactgtctgtgaacttgcagctgttggtacaccggctatttttgtaccctttcaacataaagataaacaacaatatttaaatgcaaaatatttagctgatgttggagccgcctatattgttgaacaacatgaattggatgcggaaaaaatagctcaattattaaaaaatgtagataaagaaaaattattggaaatggcggaaaaagcaaaaaatatgtcgacgccgttatccactcaacgtgttgctgaagttataatggatactgttaaaacttagccaattaaaatgaaaagaacattttgctatgtaaatgaataaaggaatgatgaatgcaagcatttagacaacgaattagacaaactgtacctgaaatgcgtcgagtaaaacaaattcattttgttgggattggcggagccggtatgggaggaatagcggaagtgttattaaatgaaggttatcaagtaaccggttcagatattgcggaaaatgcggtaaccagtcgcttaatttctttgggagctaaaatttctttctctcatcatgcagcaaatattgagggtgctagcgttgtcgttgtttccagtgcgattaagggagataacattgaagttattacagcacatgaaaaacgtataccggttattcaacgtgcacaaatgctggcagaaattatgcgttttcgtcacggaattgctattgcgggaacgcatggtaaaacgactactacagcaatggttgcaatgatttatgcacaagccggtttagatcctacttttgttaacggtggtttggttaagtctgccggaacaaatgcgtatttaggatgcagtcgttatttaattgcagaagcagatgaaagcgatgcgtcctttttacatttgcagccaatggtgtcggtagtgaccaatattgagcctgaacatatggaaacttatcatggcgattttgaagaaatgaaacaaacttatgtgaatttcttgcgtaatttgccgttttatgggttatctgtgatgtgtgctgatgatcccgttttaatggaattatcctctcaagtgggacgccaagtggttacttacgggttcagtgatgaggcggactatcgcatagaagattatcaacaaacaggttttcaggggcattatacggttgtaacgccgaatggagagcgtattgatgtgttgttaaatgtgccgggtaaacataatgctttaaatgcgactgccgcattagccgttgctaaagaagaagggatcgaaaatgatgctattttgaccgcacttgccgagtttcaaggtgctggtcgtcgttttgatcaattagggcaatttattcgtccaaatgggaaagtgatgttagttgatgattatggtcatcaccctactgaagttaacgtaaccattcaggcagctcgccaaggttgggagaataaacgtattgtgatgattttccaacctcatcgttattctcgtacccgagatttatttgatgattttgtacaggttttatcgcaagttgatgtgttaattatgctggatgtttatgcggcgggtgaacaggctatcgccggtgctgatagtcgctctttgtgtcgttcaatccgtaatttaggtaaagtagatccgattttagtctccgatcataagcaattagctgaaattgttgatcaggttattcaagatggtgatttaattttggcacaaggtgccggtaatgtgagtaaactttctcgtgaattagcgttagcttggagtaaagaatagttattagctcttcggagttacaaaataaaaaagtaggatataaaatgactaaaccattgaaacaacaaaaaatcgccgtcttattaggggggacttcagctgaacgtgaagtatcattaaactcaggaaatgcggtcttaacagcgttacgtaatcagggttttgatgctcacccaatcgatccaaaagaatatccggttgttatgttgaaagaacagggctttgatcgagttttcaatattttacatgggcgtggcggtgaagatggtacgatacaaggattattagagcaaataggcttaccctatacgggttgtggcgtgatggcatctgctttaacaatggataaaatgcgaactaaaatgttgtggaaagcattcgggttacctgttgcagatatggaagtcgttactcgcactagtttttcgcagttaaatccgcaagtagttgtagaaaaattgggcttgcctttaatggttaaaccttctttggaaggttcaagtgtcggattgacaaaagttaacgctattgatgatctaaaaagtgcggtggaatttgcacttcaatatgatgaatccgtactgattgaagaatggctttccggtgatgaattaacggttccgatattaggtaacgaagttttaccttcgattaaaattgtaccccaaggggaattttatgattatgaagcaaaatatattgccgataatacgcagtatttttgcccctcaggattaacggaagagcgtgaacaagagcttcgtcaattagtcaaacaagcttatgatgtcgtgggttgcaggggatggagccgtattgatgtcatgctggacggcgagggtaaattccgcttagtggaagtcaatacaaatccgggaatgacaagtcatagcttatttccaaaatcagctgcaactgtcggttattctttcgagcaattggtcgtcaaaattttggagctaagtctttaaatgagaataacgcataaagtaactgaaaatttgaaagtgacaaaacggaagtcctaccgatttgtcaacattaaatttattgttatgttgttattggttgcaatactgatttttattgttagtaatcgtcagtcgattttagaaaagttagatgatagctcaattaattcatttgctattgcaggtataacaaattttactgatgacaatgatgttcgtgaagttttgtctcgaatatcggacagcggtgagttaaaaggtttttttggacaagatattgatttggttaaacagcaaattgaaatgataccttgggttaaatctgtggcagtacgtaaaatttggcccaatcgcttaagtatttgggtaacggagcatttacccattgcacgttggaatgaaacagaatttttgtcatcagagggaataatatttcaattaccaattagcaaattaaaaacacaaggattacctcatttgtcaggacctgatcataaaagtgctgaggtactggaagcttggaataaaatttatcttgatttaaagagaaaaaatttgttgttaaaaaaaattgctatcaatgagcgtggttcatggcaaattgtgttagagaacgatgttgtattaaaattaggacgtggagaatggaaagataaattggatcgttttttcacaatttatccacagattgaaatacctgaaaataaaaagttatcttatgttgatttaagatatggtgttggtgctgctatcggtgtagtagattctgactaaatttaattttaaatatgtgaagtgactaaaatggctagaattgtagaagataagatatttgtaggtttagaagtaggaacctcaaaagttgttgctgtagtaggggaattattacccgatggcgttgtcaatgtattaggtgccggaagctgtccttctaaaggtattgataaggggagcattacagatttaaatgcggtcgtaacttctattcaacgagcaattgattcaaccgaagcggttgcagatagtcagatatttagtgtgacattggctattaccggtgagcatattcaaagtttgaatgaaaatggatttgtgcctattgctgaggaagaggtgactcaagaggaagttgaagcggcgttgcatacagcgagttcagtccgtattggagatgggctggcattattacatataattccccaagaatttgcagtggataagcaagtaaatataaaagatccactaggattgcaaggtgtgcgtttaagtgctcaagcacatttaatcgcttgtcatcaagattggctaaataatctgaaaaaagcggttgaacgttgtaaattaaaagtgaacaaagttgtttattccggatatgcttcatctcaagcggtgttgactgaagatgaaaaagaattaggtgtttgcttaattgattttggtgccggtacgatggatattgtggtttataccaatggttttattcgctttagtaaggttattccttatgcgggtaatcgagtgactgacgatattgcttatgcttgtgcgacttctaggacagaggcggaaagtattaaagttgcttatggaagtgcggtcagtcctccattagatcctttagataaaaaaattgaagttgccagtatcggtgggagagcacctcgagtcatcagcaaagaacaactttcaattattacttctgctaggtatgcggaattacttggtgtagttaaatctgaattggatcaattgaaatatcaattagaaaataaacagataaaatttgaacttattgctggaattgttattactggtggcggagctcaaattgaaggattaagagaatgtgcaacgcaagtattcggttctcaagtgaggattggtgtcccacttaatattaccgggttaactgattatgtaaataaaccacaatattcaaccgtagttggtttattacatcatcataataatgattttgaggatattttatctgaaagtgatacagaaactgacggtgtcggcaaaaaattttggaatatttgtaagaaagttgtcaataaagtgcggtcagagttttgaaaatttgattttttaatctacaataggcagaatttaggttttaattttgtgctaaagtcgggaattagcatttacggagaagaaatatgattgaaccggttgattacgattacgatgatattagcggaggtgcactcatcaaagtcgttggcgttggtggcggtggcggtaatgctgttaaccatatggtggctaatatgattcaaaacgatattggcgggacgctacttggcgttgatgaattggcttatccaatgtcagatgataatcatggcaaaattattttctatgctgtgaacactgatgctcaggctttgcgtaaaagtaatgtacaaaaaacagttcaaatcggtggtgaaacaacaaaaggcttaggtgcgggagctaatcctaatgtaggacgtaaggcagccgaggacgatcaggatgctattcgtgctatgttagaaggtgcagatatggtttttattgcagccggcatgggtggcggaacaggaacaggtgcagcacctattgttgcacaaattgcaaaagagctaggtattcttacggttgctgttgtcacaaaacctttctcttttgaaggtaaaaagcgtatgcattttgccgaattaggaatcaaagaattatctaaacatgtagattccctgattattattcctaatgaaaaattattaaaagtacttggcaaaaatatcagtttaattaatgcttttgctgccgcaaatgatatattgcgtaatgcggtcactggaatatccgatatgattacttctccgggactaattaacgtggactttgctgatgtgcgtactgttatgtctgagatggggcgtgcaatgatgggttccggtgttgttcaaggcacagcagctgatggtcgtgcagaaaaagcagcacaagaggctgttgccagtccgttgttagaagatgttgatttatccggtgctagaggtgttttagttaatgttactgcgggattcgatttaactttagatgagttttcaacagtaggtgagactatccgttcatttgcatctgaagaggctaccgtggtggttggtacaacgttggttcctgaaatgtcagatgaaattagggtaactattgttgcaacaggaattggggacattgaaagacaagatgttcagattatgtcaacatctccactgaatgagcccgtaaaacctgttgaacagcagcatattcgtccagaacctagacatgatttagatacaccgattacagagagattaaaagcatttagacccgtagacccaacaagtttctctcgtgactaacagagttcatcttgttgtttagcaataaggttaaagaaagatgattaaacaaagaacattaaaacaaagtataaaagttaccggagttggcttacatagtgggaataaagtgacattaactttacgccctgcgatgccaaatacaggcgtaatatattgtcgaaccgatatgaacccgccggttacttttccggcaaatgcaaatgcggtacgtgatactatgctttgtacatgcttaatcaacgaggatggggttcggatctctacggttgagcatttgaacgctgctttagctggattaggtattgataatattattattgaggttgatgcgcctgaaattccgattatggatggaagtgcgagtccatttatttatttgttattagatgctggtattgaagaacaaaatgtagcgaagaaatttattcgtgttaagaagccaattcgtatagaagacggtgataaatgggctgaatttaaaccttatgatggcttccgtttagatttcacaattgattttgaacatcctgcaattggtaaagatgtacgtaattatgtgatggatttttctgcccaagcttttgtacaacaaattagtcgtgcaagaacttttggttttatgaaagatattgaatacttacaatcccaaggtcttgctttaggtggaagtttagataacgctatcgttttagatgattatcgaattttaaatgaagacggtttacgctttaaagatgagttggttcgccacaaaatgcttgatgcgattggtgatctttatatgtgcggttataatattatcggtgattttaaagcctacaagtccggtcatggattgaataataagcttttgagagcattacttgaaaatcaagaagcgtgggaattagtaagctttgaagataaagaagaaatcccgcaaggttatgtttctcctgcacaggtttttatctaaattagtgttgtaagataaaagctatatttccagcgaagtatagctttttttatagctatagtttttgcttttacctattacttgctggtatggaaaaatattcaattcatcgtaggattttatatgtcattagatttaaatgaaattcgtcaacaaattacacaaattgaccgcagtttattaaagctgctctcagagcgtcatcgtttagcatttgatgttgtacgcagtaaagaaattacacagaaagcattgcgtgatgttcaacgtgagcaacaattattgaaagagttggtgcaatttgcggataatgaaaattatcaattggaaccacaatatattactcaaattttccaaaaaattatcgaggactccgtattaactcagcaagtatatttacaaaagaaattgaatgagcaaagagagaagaatattcatattgcttttttaggtaaaagaggttcttactcgcatttagccgccagaaattatgcaactcgttatcaggagcaactaattgagctaagttgtgcgtcttttgatgaagtattttcctctgtgcaaaatgaggaggcaaattatggcattttaccgttggagaatacaacctcaggagcgattaatgaagtgtatgatttattacagcatacagatctttctttagtaggtgaattggcttatccaattaaacattgtgttctggtaaatgctcaagatgatttggataagattgatactttatacagtcatcctcaagtgattcagcaatgtagccaatttattcgtactttaaagcgagttcatattgaatattgtgaaagcagctcacatgcaatgcagcttgttgccagcttaaataaacctaatattgcggctttaggcaatgaagacggtgggaatttgtatggtttaaaagtactaaagtcaggcatagcaaaccaagaaaacaatattacgcgatttattgttcttgctaagcatccgatcgcagtatcaccgcaaattcatacaaagaccttattgttaatgagtactgctcagaaagtgggtgctttagttgatgctttattggtcttcaaaaaatataacatcaatatgacgaagttagagtcacgtccaatttatggtaaaccatgggaagagatgttttatttagaaattgaggctaatattaataaccctatcgctcagcaagcttttactgaactaaaagcattcagtaactacttgaaaatcttaggttgttatccaagtgaaattgtgaaacctgccgaagtctaataaaaagtgcggtctaaatcaaaaaaatcccctttattgaaaaaggggattaggcgttgatttattttttcggtgcaagcaattcaggttcttgaggtttcgctacattttcaaaagatttattttgattcgcttgaataaggctgtctgcttgttgagccaattttgttagccccattttttcgtaagcatttttcatcaatggcaacgcatcaagagtagctttcgtgtcaggatattgttgtaacatacccactacacgatttgctacagcaacatgagcattgcgttttgcatagaatttagcaatttccaattcatgacgagcgaggcttgctctaatataagccatacgtgctaaagcatccgccgcataagggctatttgggaaatgctgaactaacgtttggaagttagcaaatgcagttttgatagacgtactttcacgtgtcgcacgatctacaccaaaaaggtcttggaaccagttatcacctaatgctgaattgcttaaacctgctatataaatgacataatctaaatgcgagctttgcgggtattgttgaataaagcgatcaattgttactaaagcattagtgtagtcttgagatttatagtaagcataaattagatccaattgtacttgttcattatattggcttcccgggaagcgtttttttgccgtgtctaaataacgaattgcttggctataatctgagtcttgtagatagctgtgtcctttttcataaagagtttgtgctgttccttcttcaatagctttacctgagcttgaacacgcaccaagagcaaggcttgcaaaagcgactaaagcgagagatttcaatttatgcatgagtgaatccttatttttacaatcaataataaatgttacaataattcgttattttatagcacattgctaaataagcaaattatctgatggattttttattatgacacaagtgatattgtcagccgatattcagccccaacatatgggacaacgcttagaccaaacgttagcagaattgttcccggattattcccgttctcgtttgaaaacatggattgagggtgatttagttaaagttaatggcgaaattattaatgttgctcgtacaaaagtttacggtggtgagttagtggaaatttgtgtggaaattgaagaagaaagcaagtttgaacctgaaaatttaccactcaatattgtttatgaggatgagcatattttagttattaataaaccaaaagattttgttgtccatcccggtgcagggaatcaaagaggaactgtattaaatgcactgttgtatcattatccaaaaatagtagaagtgccaagagcgggcatagttcatcgtttggataaagatacgacgggtttaatggttgttgcaaagacaattccggcacaaacaaaattggtacaggatttacaaaaacgtaaaattatacgtgaatacgaagcagttgcttttggtgtgatgacacaaggtggaaaagtagatcaacccatgtccagacatccgacaaaacgtactcaaatggcggttcatccgttgggaaaaccggcggtaactcattatcgtataatggaacgtttccgtaattatactcgcttacgccttcgtttggaaacaggacgcactcatcaaattcgagtgcatatggcacatatttcccatcctttactaggcgatcaaacttatggaggtcgtcctcgtccaccgaaaaatgcaagtgaagaatttatgcaagtgatgcgtgattttaaacgtcaagcgttgcatgcaattatgctccgcttaactcatcccattacaggcgaaataatggaatgggaggctcctttgcctgatgactttgtaacattaatcaatgccttaaaagcagattatcaattacataaagatgaattagattattagtatgcaaataataaaagcgaatctcggtcaagtagcgaatgttcaagggctaatgacaactcggcaaggcggtgtaagtgttgcaccttatgacagcttaaacttgggtgatcatgtcggtgatgatgaaagtgcggttaaaattaaccgcactttgttagtgaaagaattaggcttaccgcaagatcctatttttcttaaccaaacgcatagtacaaaagttctgcgacttccttaccaagaaggcatggatttaaatgcagatgcagtttatagtgatcaagctaaccaagtttgtttggtgatgacggcagattgtttgccggtactttttactaatagacaaggcaatgaagttgctgctgctcatgccggttggcgaggattatgcgacggtattttagaggaaaccgttaagcaatttcgtgttcccaaagaagatattatagtttggctaggtgttgctatcggccctaagttttttcaggtcggtaaagaggttgttgagcaatttatagcaaaagatcctcaagctaaaaatgcctttacgccagatcgggaacaggaaaataaatttctgggtaatctgtatcaaatcgccaaacagcgtctaaatgctttgggaattacagaaatttacggcggagaacattgtacatatagcgataaagagcggttcttttcttatcgtcgtgatggtaagacaggtcgattggcttcattgatctggttttccaagtaaaaaagagcggttagttgtattgagtatctaaccgcttaacagggaatagttattatccttcgaagccgtcaaacaaggctgtgcttaaatatcgttctgatgcagaaggtaagataacaacaatgagtttatcggaaaattccggacgttgtgcaattcgatcggctacagcgagtgctgcaccggatgagatccctccgagaataccttcttctgccattagacgacgagccgttataatcgctgtttcactactgactttttctacttgatctactaaagataaatctaagtttttcggaatgaaccccgcaccaataccttgaattttatgtggtcccggtttggtttcttcacctgctagcgtttgagttatcactggtgattcttcaggttcaacggctacggtaataatttttttgccttgatcttgcttaatgtaacggctaattccactaattgttccgccagtaccaacaccagctaccaatacatcaattttaccttcagtgcctgaccaaatttcaggtcctgttgtttgttgatgaatggctggatttgcagggttttcaaactgttttagcattacatagtgatttggatttgaagcaacaatttcttccgctttagcaatagcccccttcataccgttgacaccttcagtcaacactaaatttacccctaaacctcgcaataagcgtttacgttcggaactcatagtctccggcatagttaacgtgattttatagccacgtgctgcagcaacataagctaaagcaatacctgtattaccactggttgcatcaataatttctttatctttggttaaaataccatctttttctgcttgccataccatattggcaccaatgcggcatttcacgctaaagctggggtttctcccttcaattttcgctataatgttgccgttattaccaaagttttttaaacgaactaatggtgtattaccaatagaataggaattatctgcataaattgtcattattttctcctaagagttgtgagtagtattttttacagtatttttatcatagctttatgaatttcaaaatagcaaaacattctattttataactaaacgctatttcacaatcgtggttttaatccgtatgaggtttgttaatgtcgttcttaccggcataacgatattgttcaacccacatagctgttgcaccacagacagcaacaggaataatcagcaaattaatgagcggaataaatgtacataaagtcaccaaagtaccaaaagttaacgttaatgtatgtttctgtccaagttccgttttcatacgttgaaaaggcactttatggttatcaaaaggatagtcgcaatattgaatagtcatcatccatacagtaaacaaaaatgctaaaattggaataatgctttgtccaataaatggaatgaaactaagtagagatagagcaataattcgaggtaagctataagtcaatttttgcaattctcgttttagcattcttggaatatcttttagaaaatctaccgcacttccttcagtcggactttctcccgttaacattttttccactttttcagcgagcaaggcattaaaaggtgcggcaataaatccggagagtgttgtaaacataaaataaaaaatgcttaacaacataagtacagctaatatgagcagaatcatacttaaccagctaagccaatcgggaataaacgtgatcatgctctcgagccaagtgctgaatcggtttataaataaccataacagccccgataaaagaagaatgttaagcaaaatcggcataacgacaaaacgacgcaaaccacgttgtctaatcaaatcccaacccataataaagtaatgaaaagctttttttatctctgttagttttaacataaattttccttaattgaaaaaacacacttatcaaacgacataataccgcagaattcaagtagggtaaaaaatctgtattttccatattaatcaacaagtaaaatatgataagctagcaaaaatttgctgttcgatgaagctaagtaggagaacaagataatggatttaaatgctattttaattattttaggtgtaatcgcattaataattttagttgcacatggcatatggtctaatcgtcgcgaaaaatcgcagtattttgaaaattcaaaaaactttactcgagaggcacgtatccgtgaaccacaagaaaatcagcaatatcaaaccgctgatcaatctcagtcggattttcaacgtaatttgcttgaaactgataatgactgtttttctagtgaatcagcacataattctcaccaacctctttatcattatagtgagcaaagtgcggtacaatctgttgatcaaattaaaattaggttgcctgacagtgagcctaactatgtaatgcaagaacagttctcaccgaagcataccgactacgcctccatgagcattgaagaaatagaaaaatcaattgatcttgatgagggaattaattcatcttctcgacatttacgccaagaactagctcaaatttcagggcaatcaatagctgatgataaggtcaatatagaagagcatatgtttactgaaagcagcatatcttttgtagaaccacagacaaacacggaatcccaacaggttgttgaaaaaacaaaatcgggtaattcttcttttatcatgctttatgtggttgcctctgaaaatcaaggttttagcggtttgcaattgactaaaacacttgatgagctaggatttatttttggtaaaaaacagatttatcatcgtcatgtggacttaagtattacaagccctgttttgtttagtgtggcaaatattgaacagcccggtacgtttgatttaacaaatattgcagatttttacacggttggaattgcattatttatgcaactgccttcttatggtaatgctacagccaatttacgaatgatgattagagcggcaaaaaccatcgctcaagatttagacggtgttgttgtaacagagcaacaagaaatttttgatgaacaggctgaaagggattatttggctcgtgtttcttgagtggcaaaattcgggaaatattgaccgcactttatgctttaaactttcaataggcttttgtttaaaaatactgaaaactatttggatgtgggaattctacgtcaaaaatgctgtatgaatttgctataatcaacgaaagacgcaaaacaagtgtgaatttcagttaaattattgccataaaatatgatttatatcaataaagtattcaatgttggttgagtttgtaggttaaaattttgtagtatatgcaccatcaagtgattgcttgatgttcataaagttcctaaataaaataatcataatatagcaaaactgctttgtgacctccctcttgggaggtttttttaattaattacaaagttggaagtttaacgtttctttgactgataaactgttcttttcctgtatgtctatggcactaagtccttactcgctaaatttctacgttcaattcgctaaatcctataatttcaagtaaaataaccgcactttttacatcatagagagaatatatgtcatcacaatttgtttatactatgcacagagtaggtaaagtagttccgccgaaacgtcatattttaaaagatatttctttaagtttctttcccggtgcaaaaatcggagtgcttggcttaaatggtgccggtaaatcaaccttattacgtattatggctggaattgataaggatattgagggagaagctcgcccacaacccggtattaaaattggttatttgccacaagaacctaagcttgaacctcaacaaaccgttcgagagaccattgaggaagctgtcgctgaggtaaaaaatgcgttagttcgcttagatgaggtttacgccttatatgcagatcctgaagcagactttgataaattagcaaccgaacaggcaaatcttgaggcgattattcaagctcatgatggacataatttagaaaatcaattagaacgcgcggcagacgctttacgtttaccggattggaatgccaagatagaacatctatcaggcggtgagcgtcgtcgtgtagcactttgccgtctattacttgaaaaaccggatatgttgttacttgatgaacccactaaccacttagatgcggaatccgtggcttggctagaacgtttcttacatgattatgaggggaccgttgtggcaatcacccatgatagatacttcttagataatgtggcaggctggattttagagcttgaccgaggagagggtattccttgggaaggcaattactcctcttggttagaacagaaagagaaacgtttagctcaagagcaagctacagagtccgcgcgtcaaaaatctattgaaaaggaattggaatgggttcggcaaaatcctaaaggtcgtcaagctaaaagcaaagctcgcatggcacgctttgaagagcttaactcaagcgaatatcaaaaacgcaacgaaactaacgaactcttcattccacccggtccacgtttgggtgataaagttattgaagtgcagaatcttaccaaatcttatggcgaccgcactttaattgataatctttctttcagtattccaaaaggggcgattgtggggattatcggagcaaatggtgctgggaaatccactttattccgtatgctttcaggacaggaacaggcagattctggctctattactttaggtgaaaccgtggtaatggcatcggttgatcaatttcgtgatgcgatggatgacaaaaaaacggtttgggaagaagtttccggtggcttggatattatgaaaatcggtaattttgaaatcccaagccgtgcttacgttggacgtttcaacttcaaaggcgttgatcaacaaaaacgtgtcggtgaattatccggtggtgagcgtgggcgtttacatttagccaaacttctacaagtgggcggaaacgtattactattggatgaaccaaccaatgacctagatgtagaaacgttacgtgcattagaaaatgcgatattggaatttccgggttgtgccatggttatatcccatgaccgttggttcttagatcgtattgctacccacattctcgattatggtgatgaaggtaaagttactttctacgaaggtaactttaccgactatgaagaatggaagaagaaaactttcggtgcagaagcaactcagccacatcgtattaagtataaacgtattgcaaaataattctttgtataaagggaaatattatgaaaaaaatcattaccgtattatcagttttagctgtatctgcttgtgtttcaacagagctatcgacacaaaataagacatataacaatttacaagatgcacgtatccgtttatatgggcaaaatcgtcgtccctcatcaatggaaattgaaattaatggcaagactgaaaaaatcaccgttggaggtggtttgggacaggcttttggttcaatgcttggagttaaagggaatgaaagcattggtatgcctgaaactgaacttagcaaagatccttctgctcattcaaaactactttcggctatcttctttaaagaattcgttataccggcaggtaaagaagtaaaagttactaacagtattcatgacgtaacgaatatgggagaatattatacctcaacacatagaataaccaccactacaacatttaaagggtgtaacggtgatgtcattacttttattgcagaagcaggaaaagattatgaagtggctcctattagctctaatagagaatgtggtgtaactgtttacgagatcaaataattttatcagaagcccattataaactgtctataaagtaaccgcactttaagtgcggttactttatgttgcgtgattatggcaggctcaatatcagcaataggatattcacttttaccggaaaaatcattgaaaattaacaatgacaacataaagctttctagatgaaatcagcacagaagagttgccccgaaggcactaaaaagattagcgaccgtatttgttgaacaagaaccttgccgagcttttatctgggaaagtcaaaaagttcgtcgtactgtgctgtttgttgctaaaagtgttggttttattggaaacctaacctggtcataaaactctgtaaaactgtttgcggatctaaatatattgaagaaaacaaccgcacttattggattaaagtgcggtaagtatttagctcaaattggacgctgtgataagacgttgcgtataagcatttttaggttgggtaaatacctgctcggttgtacccgtttcgacaacctcacctttactcataacaataacattatcgcttagtgcttttactacagataagtcatgactaataaaaatatagctcaagccatattttcgttgtagtttattgagtaattcgatgacggtaatttgtgttgaacgatcgagtgcagaagtcggttcgtccagcagaacaaatttcggttcaagaataatcgcacgggcaatagcaatgcgttgtcgctgtccgcctgaaaactcatgagggtaacgattaatcatagagggagaaagattaacttcctccaacatattcatgactttttgtcgccgctcttgtttactcatgtgcgggcaatgtacagtaagaccttctgcaataattttatggggtagtaacaatatttgcataaagtaaaagaaaaatttgggtcggaaaaagttaggtgagggcttgtggttattgggtttgttgaggttggggcgttggttttatgcaaaatagggaaatgagcaggaatggtaaaaaatgggtaaaaattggattattttttgcataaaagtgatcrgggtttagatggtttttaaaagatttttaaaacaggtttaaawctytaaaaatggyartaaaraytaggcaaggcgrtttcaggtgaaatcgcctttatttttttggggggaaatcttgtggttttggtgcgtttaggtgaaatctgacttatttttgtgagggattatgcctaaaaatcacgatagccacgcactacttgcccaataacgataaggctatttgcttcttcagcttctagctttaatgggcggtatgttgggttatcgctaattaactctaccccatcataggttaactgcacttttttcactagcattgacccatcattatttaaaacaaatattttcccatcaactaaattacgtttagagcgatccacaatgatttcttcaccatcttttaaggttggatacatactttcaccgctcaccaaaaaacattgcacagttttcagcctttaagtgctttgtttgtagccaaacaagttctacttttatcatctgtgagaactacacagtaaatttatttaactgtgtagttagtaccaattttttataaagtaaacagaatacataaaagaacaatataatcaatgtgttataaattttaggcgttttttttcggatttctttttgtgtagtctaataactctttttctgtgtattcagctaaacgcatattagcgattgaatgcttacaacacattttggctgtttcggagattaactgcttaccttgagtatcacttcttctaaaatttgccagtaactttatttcatccatattcagtaaaactggatttattgcatcagaaggcgtgattagtgaagggttaattgtggcagaataatcatccatatctatttcagttgctttatctttaatggcgttcacaagatcctcattattagcattatttggttctctaatcccagatagaatgtaattgatatccagttttaaatctggacgctcaagctctaatagtcttaaggcattttcaggaaatacacctctacgctttctttcagcaaaggcactttttgacatttttaaaagttcagccacctctttatccatcgttaatgatagttcagtttttaatcgattggcgatgtctgtgaaatttttcataaaaaacctcttgaaattcataaaaatcatatttaatatgaactcagtaaacaataatgaactttatgatttcatattaattcgtattgttcttattctagttcaaaatatgtttttagtccatagaggagtttatatgaaaaaaagaacgagagatgaagctaaaaattggttcagagaaatgaatgtaacgcaatctgaatgggggcgaagaaatggttatagctctaatgaaattagccgagtattgacgggaaaatcaaaatgcctttatggaagagaacgagaaattgctattaaactcaatatagctttagaaagttagaggttcatatgtgtgaactaaagccatactattctgctcaagagttaataggtttacagctagtaatcttaccaacgaccaaaaaagcagtaatagacaaagccaaacgcgaaaattggcaatctcgtaaacgtgttggtcgtggcggtggtgttgaatacgccctttcctctctccctcaagaggtgcaagaggaaatcagagataaatttgcgacctcggttgtggcgggcaagcctaaaaagttgccagtgttgaaatcggtcgtgttggaagacctcaccgaaaaacaacgccaagcggcagatgcaagaatgacgttagtggcttatatcttgcagttggagcaagcacaacctcgttataaagcggtgaagtttttttgccagcaggcgaaacaaaatttgttatcacctgaattaatggcattagtggctaaggcgaataacaaaaaaggtgaaagccgtgtgattggtgaacgcaccttaaatcaatgggtgttggattatgaaaaagcgagcaccccagaagaacgtttaaaagctcttgcccctatgcaacgggtggcaaaaaaggcagaagacatttcgtggttgcctgattttctagcggaataccgccaaaccaatggcattaatgtggcagaagcctatgggtattttgctcaacattggcgagagcgttttgaggatcaacccttaatgcttgagatgttgccaagtcttaatcgtgtcagaagagcgttagccaaattgcctcgccatattaaagaaattgggcgtaaaacggggtcagagcttcgggcattaaacacttatgtgaagcgggattggtcgaaattgttggtaaatgacatctgggtaggcgatggacacagtatgaaaatgaaagtggctcaccctgaacacggtagcccttttatccctgaaatcacgctgattatggacgccccttgtcgttacattgtgggttggtcggcaagtctgtcagaaaacgcccttgcggtggcagatgcgttacgcaatgggatcgaacagcacggtatccctgcgatttattactccgataacgggggcggtgagaaaaactggctacttgatggggatattacagggatgttgccccgtttaggcatcaatcaccaaacagggataccgggcaacccacaagggcgtgggattattgagcgggtacaccaaacgattttataccgcattgcacgccaatttgaaacctatcacggcagcggtgctgatagggaaacggtgagaaaggttagcactggcgtggtatcccttgaaaaagccttgcgaaaaggcactgcacttgaagatttaaccccgaaacaacgcggggctatgggtaagttacccagttggaatcagtttttagatgcggtgcaagcgggcatagattggtacaacaacgagcataaacacagtgaaatcggcaatgttacccccgcagccaaacgccgtgaattaatggcaaaaacgaatgaagaaaacttggtttacctcacccaagttgaagcacgggatctgttccgcccagcggtagagcgtacaccagagcgaggttgggtgcggttgtttaataacttttactttagtgcgaagttgttagaggtagatagagaaaaagtgcaggtggcatttgatattcacgacccaagccgtgtgattattcgcaggctagatggggtgtttgtctgttatgcagagcttgatggcaataagcgtgatgcgttcccgatgagttttgtggagaaaacgagaaaagagcgtcatcaacgccgaatgaagctaaaacaagagcaacttgatgaaattaatgcggaactcaaccccgtgcttaccattgaacacaaagaaagtgcggattggttacatcagttacgcataaataaacaaaatgaatgggaggaagacgcggaagaaattgcggttttcccaagtgaaatgaaacgtcaattattaaaaagaaaggcaggttaaacaatgaaagagcaattacaacactatatgcagacacaggggctaacgcaggggcaaattgctaaggcgattggtaaatccatcaccactgtgagccagtatttaaaaggcaattacaacgggaaaaccgatgaaattgatgatgccgttgcccgcttgttgcaacgtgaaaaagataaggtggtggaacgccgttttaacagcgaatttgtggaaacttacgcggcacagcgttgtttagatgctatctacattgcccacgcagaaagtgatattgcagtgatcacaggggcggcaggtttaggcaaaacccaagcactaaaacactacatggaacgcaaccctgaaaccatttttgtggaagttgaaccaagttacagcccgaaagtgttacttaaaaatctgtgtcagcagttgggactaaacgaaaacggactaaatcacgagctctttacccgtatcaccgaaaaacttggcgaaaaccgcttaattattgtggacgaagcggaactattaagcacgaaaagtttggaatatttacgccgtatccacgatttaaccaagtgcggtgtggtgttggcaggaatgccgagattaatcgttaatttaaaaggtaaatatggtgagttagcccagttatacagccgtgcgggcgtacattgcgatttacaaaacgccctagataaggaagacatcgccttacttgcccagcaaggcttaggtacggacgaatttaacgacctgctttacaaagtaagcaaaggcaacgcaagacgattgaacaagttaatgcgtggcgtgatccgcgtggcggaaatgcacggaaaaccgattagcgaggcactgattaaccgttatgcggaaatgttgattaattaaggaggaaatatgggctttaaaacaaaagagtttgataactggataggaaaaaatggtgacattttgatttctaaaaattcaaaagataaatggattgctgcagggggatggagcgaagaagaggacgactttactttgtacagcgtattaaagaatagaaaggcatggctgaatttttaccgtcaaacgagagtgactaaataaggattaaggagaaagaaaatggcaagagcagacattattgacacagcttatgcgttacgtcgtgagggtgtggagattgtgaaatcaaaagatgggcgttttccgagttttttaattttacgcccaagccaacgcttaatagcaaatgcaacgcagattgtggaacgcattaacgggcaacgccgtgagcggtttatcactcaagtgggaaattgtacggtgtactggttttgaggtgagcaatggcaaagtctctggatatttacgccgtctatgagggtgaggataacttaggtgacggcacagcggaacagttagcaaagcaatttaacttaagtaaaacaacgatttaccgttatgctaagttaggcgataaaggaagtaagaaaaaacggttaatcatcatcaaaattgataaagaggaaaaagaaaaatgaaaaaaattgccgtaatttgcaccgcacttttgttggcggggtgcattgaaaaagcgccacttaatgatatacagccaataaaaaggtatcaggtaagcacatacggcgaacttaaagaggtatgtattgatggtgtggtgtatctactactcataaagggtggtattaccccaaaaatcaacgccaattatgacgtttatatctgtaaccaatcaactaacccataggagaaaacaatgaaaactgtaatcgaaggcaaaacctactggaaagatgcaaaaggcaaccttaccccagaagaattagtgaaagacatcgacaaagaacgcgatgcactggtgcaagaatgggtagaaaaagccaaagccttaaacgcggaaatgagccgttttaaaggcgggatttttggcgatattcaggcgtttgtggaactttccgccgaaaaatacggcacaaaactgggtggcaataaaggcaacgtaacgctatttagctatgacggtaaatacaaaatcgtgcgagcgattagcgatcatttgcaatttgatgaacgcattcaggcggctaaggcgttaattgatgagtgccttagcgaatggtcggaaggctctcgcctagagctaaaaaccttgattgagcgagcgtttgatgtggataaagaaggcaatatcaacacagggagaattttaggcttacgccgtgtggaaatcaccgacccacgttggctaaatgcaatgcaagccattagcgaaagtgtgcaaatcgtaagcagtaaagcctatgtgcgaatttatgagcgggtgggtgatagcgatcaatatcagccgattagtttggatatggcggggatgtaaaaatgtttgaagatgttagtgatttaaaagaagcctatgatttttataaagcagttaagaaagataaagatgctattaggtgtggttgtttaagtgacgcagaagattggatatggagagagccgcatgcgttatttgcagaagacgatgagcaggaggtatagcaatgttagagaaagttgcaaaatacagtcgaattttttcgggagcagtggcgattaccatattgctgattgcagtgcctgtgttttttatccacgaagccgtagcgataaagttgatggcgtcagcgtgtaatttttttgccatttttgtcttttttgaggttttaaaccttaaaagttgggtacaacaaaatatcgcaacattgataaaaagtgcagaaattgcatcaaaagccgcttatagcttaaagcagcataaagggctaaatcttgtggtcaatggcaacacagttacacctgatagtagtgaacgggaggtataaatggaaatgttactttatatcgctgttggcgcatttttattccctttttgttttggtttaggttgtatatgcgtctataaaatgatggagaaattggtcaagttaaatatggattaaagcccttttcaacacgctttaaagcccatttaaggcgtgtttataaagtgttttaaatcaaaaaataggagcaatgacaatgaattatcacgctgaaatagacgttaaattgactttgggtattgaagctgaaaccaaagacgaggcgatatgttatatcgaccaactactggaagaaatccatgaaggctacgctattggtctgaagtatcgaattaattttgtaaatgaggaatgcgacgatgaagaataaatatcttgtcagagtgtacggaatggttgaaatcaccatggaagccgaaagtattgagcaggcaatggcacaatgtgatttgaataccttagatttaaataaattgccacatcaaatcackgarattgaygatgtrgttgaagtggaggaagtatgacaaagcaaaaacaaagcgarctymrgctmaagctggatatgatgatcggacagctkcaacargcrrtkmragcsattaayacgggyaaytatattrcrgcsggggtrtatatggawatggtrcaaaaccaactgcmaaaggcragatggcargtaagggggtaaaratgaaatcttttacattaattttaacagcaacttttgattttcgcgatgatgaatttaatgatatcggttttaaatggtctagtatagacggaaaggcattattagatgcgccaagagaactggattttacaatttataaattgatgaaagattgtacttacgcattgcctattttatcccatttttttaaggagtttagtcaagagaagcaacccgtcatggcaactgcaagcgtgcagtttgaaggggaaaatgaggattggcagctagctttttctgcactagaaaaaaacgaagtaaacgaatatatccaaggattgctttttgggttgctaacacagagaaatgaacttttgcggaaggtgaagttattggaaaaggaattgtattaaaacccatttaccgcccttttaaatctcccctagcccctctttaccaaagaggggaactgaaagggcggaataatgtgttttaaccccgttttaaaaggagtttaaaaatgaaatgtaaatgccctgcgtgcggggcggtgttgtcgttagatgtgttgttgcaacacgagcaagcgagccttgcggtgatgaatgccttatcgctcaatggcgagtttgggcggttggcggtgcagtatttagctctattccgccctgaaaaatccgcactcacaatggatcgcttagcgaaactactcagtgaattggttgatgaggtgcaacgcgggcagttttgccgtaatgggcaggtttattcagcccccattgaatgttggattgatggcttaaccattgtgttaaatagtcgccaccatatcaaacgcccctcgcctcacacggctatttgtatgaggtgatgaccaaatggcaaggcagaaatagccatcataatatgatgaacggacaaagtaatccgcctgccactgccccacaattcggcagcaaaacgggcaaagctctgcaaaatttagcggagtttgccaatggctgacgaaaaatggctaaaacgaaccgtagctcaagggttgggaaaattggtggtgttacgccttgccaaccaaccgcccgaagagatgatcaaggctacggcagaagtgtgggtgcaggtgattttaagccaacgcatttatggcggctggcaagagaaagaagataaatggcgaattgaacaggcgtttatgcggttatgtgcagaatgtgagcgtttccccgccccgaaaatgctgttagaccgcttacccaaacgtaaaacccttgaactaccaccacctcaaccaaaaccattaaccccagaacaacaagcgcgcgtcagtaaaatgttaaacgaatggcgaggagtattaaatgcaaaacgatagttaccgaaaaaatctcattgctaaagtgcatattggtaaaagtcagttaaaaatggacgaagaaacctaccgcacttttttaatgaacgccgtaaataaaaccagttgcaaagcaatgagtaacaccgagcttaatcaagtgttggatttaatggcacaacgtggggcaaaagtgcggtcgaatttttggggaaatcgcccaagtccagctaaagcgaaaaagccgtaccttgccaaaatcaccgcattacttgctaagcataatcttacaccgcaatatgctgacgcgattggcaaaaaagcctttggtattgaatttattgactggcttgctgtgtggcaattaaaaaaagtgattcaaatgttgtcggtgtatgataataagaagaagttgtaaaatattttgcataagtataaattaaaggttcgttttgagccttttttaatggagcaaatatgagaaaactgataaatctcttaatatttacaataatacttattccagtatcactgcaattattatctaatcctgcttggggaaagggtcgttatctgccaaaatgcaatgaagtagatgatcttttaagccaaattttaaatcagcaaactaaagaaacaaatattgacttaacgctcaaaaacattactgctgttagagaggtaaaaaagatagaacaagataaaaatatacgtctttgctacgcaattttacaaacggcaacctacaataaactagaagcattatattcggtttctcctgatggtaatgatttttgggtgcaaatagaagaagtaaaccctattattgatgccaagacattaagtaaaacgggtgatatgttaaataatcaaatgggagaagatagattacaggcttttgaaatggcgaaaaaatttggtgatatgaaagaggcttgtctatccttgagtgtcgccaaaaatttttcttaagtgcaaaaaatgaggttaaatatatacaaaccaataaactattagaagagttctgcaaaaagtaagtataggctatctaaaatcccgccaagtgcgggatttttttcaaaaaattctccagttaagtgatcgtttgaaaaatcccgtgtgataatggcgaaaaaatcaatacgggagattaaaaatgagtcatcttgaagatgttgcagactgcttaccccctgttgtactggaaatggtggatttggtgggctttgaggtaaccgaaaaaatcattcgtcattttggcggggtatgttttttatttagtgatggtgcgatgtatttcccgaaactaaaatcgctggttggattagaacatgccaccgcactacgccagtattttaaaagtgaagaagtctatattcctcgctgtgaagtggcattaagaaccttacgtaatattcgcttggtgaatgactttttaattaaaacccaagtggagggaaaaagcgggcgtgcagcaatgttggaactttgcaccaaatatgccctttctgatcgccaagcgtgggaaattgtgcgtaatgcccaacgtaactcaccgcttgcaaccaaatcatccctattttaactgtggaagtgctttgtctattaggctaaccacacaaatctgataatcacctcaataatgtctttgattattgaggttttttatgccctttccaattacaaaaattgtggtgcattgtagtgccacgcagaacggtaaatccttacgcaatgaaaggctaaccgcagcccaacggattgatctttggcacgctaagcgaggttttttgcggaaaaatcaccaatttaacccgtacttacgccatatcggctatcactttgtgattgataccgacggcactgtwgaaacaggacgtgcagaaggagaaatcggcgcacacgttaaagggcataacgcccatagtttaggcatttgtcttgtaggtggcattagcatcacaggcaaaaactacggacgctacactgtcaaacaatggcaagccttgtatcaactcttacaaaagttagaagccaaatacccagaagcacgcatttgcgggcatcgggatttatcgcctgatttaaacggtgatggcacgattaccccaaacgaatgggtaaaagactgcccgtgctttgatgtttgggagtggctggatagcgagcaagtgattaatcaatcacacttatttaaggagtaattatgccaacgactattttaggtattatcgccgtaacaatggtaatcggttgttttttcaaggtcggggaagctatcggagcttgtatcggcgatcagattaaatatcgctatgtactttggcgagataaacgaggggaaaaatgaaactcagtgaattaattaccaacgataacggcaggcttagcaccaccgcctttatccaatttttcggagcggttttaatggcgatcattttggcgtatagcgtctatttagaccgtgcaaatgtaagcgaactgtttaccacctttgctttattttgtggcggcggtgtggccaccaaaggctttgccaatgcccttaatcgccgtaaatcttcactagcacaaggagaagaacaatgatgtggcagatgtatgcccttgcggggctaggtgcagtgtttgtggcgatttatgctcggttacattggcaaagtaaaaaactcagtgaaaagcaaaaagaaatcgaaatggtgaaagccgaagccagagccatcgcggaggaaatggaaaatgcagaaaaacgtcagcaaattgaagcagctcatcgccgtcttaacgctcacggcgttgatgaccagttgcagtcaaaaggttacttccgtgaggattagcggttgcagtgcgtttgggctgatttaccccagtcgtcaagatacattagaaaccaaacggcaggtgctgaaccataatttagcctatgagcagatttgcggggtgaaacgtggatctacaaattagcggtgagtgggtgtttaacggggtggtatccattgccgttacctttgtcgggttttggttgcgatcggtcaaggaagagctgaaagaactcaaacaagaatgcaaagacatccgcaataactatcaaactaaagagcttgccaaggtgcatagcacacacacggacaatattttggcggaaattcgggacgaattaaaagcaatgaatcataaattagacagcaaggtggataaataatgtcagccagagaacaaaagcgtttgaaccaacgcaacaccaacgaaaaactcgatgaactgttggatttaagcaaagaagcgaatcgcaaaatcgaccgtattggggagcgggtcaatgatattgatcatcgtttgtcatcgctcgaaacccaagtgggcaaagtgaccaccaaagcctttgtggctggcggtttaggtggtgcaatggttgcggtgggcattgagttaatcaaagcaaaatttgggggctaaatggctcacgatgagaaagtgcgggcattagtacgccgttattatgtgtttgaccgctttacccttgagcaatctgcacaaaaagctgacgtgtcttttggtacagcgcgccgttggaaagcgcaagccctaaataaaggggacgattgggataaggcgcgcgatgtgcatattatggcaggcggtgaagtgaatatgatttcgcaaggtttattggcgggatttattttgcagtatcgcaccacaatggacgaattacagcaaaacactgaattgagtgccaaggataaggtgatgttacttgccgcccttgcggatagctttaccaaaatgacggcagcaagtaagcggattttgccagaagtatctgaattggcggtggcaatgcgtaccgttgagttatttggtgagtatatccatcaacatcattcttccctaatggagccttttattgatgcattgaatggatttgggcaaacactcaatgaggaatttaaaaaatgaacctattgagttttctttttgtgattgcggcttgcctttctgcccgtgatggtggggcgtggggctggtgggtatttttagcattattagtgagtgattaaaatgaaaagcaaagattttttgaaagaattaagtgcttatgctgatagcctacggcaaaagttagaagcctcttttgagggctggaatgatagccctgaagccgtggttgaacgccgtaaaaaagtgtttgatacgatttcgggttatgaatattttgtcaatcattactttccgcattacacccgctcaagctcaaaatccaaattgcatcattatctatttgaacgcttgcccgccattttacagcaagagaaaggttgcctagatgccattgctgcaccccgtggtgaagctaaatctaccttggtttcgcagctttatactctttattgcttggtgacccaacagaaaaaatattgcctcattgtcatggacagtatcgaccaagcctacccaatgttggaagccattaaagtggagttggaatttaatcaacggctacgcattgattttcccgaagtggcaggacaagggcgtgtgtggcaagcagcaacgattgttacccacgctaatcaaaaggtgcaagtggcaggttcgggcaaaaaattgcgtggtttacgccacggggcatttcgtcctgatttggtggtgctggatgatattgaaaatgacgaacaagtcagaagtccagaacagcgggataaattgcataactggttaaaaaagaccgtgttaccgcttggctctgcgggggataaatttgacattgtgtatatcgggacaatcctgcattacgacagtgtactcaatcgcaccttgcacaataaagcgtggcatacggcaaaatttaaagcactcacaaaaatgcccgacaatatggcgttatgggataagtgggaagatttttacctaaacgagggcgaagcggttgccgatgccttttatcagcaaaataaagccgaaatggacgcaggagcggaaatctcttgggcagctcgtccactcttggcgttaatgaaaatccgagcacgagatggacacgccacctttgatagcgaataccaaaacgacccggttagcggtgatgatgccatttttgccaacagtatccaatattggacatcactccctgataacctgatttattttggtgcgcttgacccttcaatgggtaaggcgggagctagtcgcgacccgtccgcaattttagtgggtggctatcatcgcgaaacaggcaagctctatgtgattgaggcacagattaaaaagcgtctgcccgatttaattatcgaagatgtgattaggctcaatagccaataccaatgccaccgttggtttgtggaaacggtgcaatttcaggaatttttgcaaacagaacttgttaagcgttccgcccaacggggcaagcctgtgccagccacggcgattaaaccgaataccgataaaatgctacgtattgagagcttacaaccgcatatcgtcaatggcttaattttgttgcatcacagtcaatccaccttaatttcacagctacgtcatttcccaaaagccgaccacgatgatggtcccgatgccttagaaatgctatggaaaaatgcggtgctcaactctgcctccattgagtggacaagcctgaatgaagcagagttagataacgattggcgtgatgaagatgatgatatttatagcatttggaaaggataaacaatggcaaagaaaaaacgcaataagcacaaacaagcacaaaataaaagtgcggttaaaattgggcaagattttcaaaccaacgaagctcgtattacggagaatgggcggattatttccgaccacccaagcaataaaatcacgcctgccaagttaaaaagtatttttgaggatgctgaggcgggcaatatccaaacccagcacgaactctttatggatattgaagagcgggacggcgatattgcggcaaatatggcaacccgcaaacgggcgattttaacgctggattggcgaatcgccgaacctcgcaatgccacgaccgccgagcagggctatcaacaagaggtggacgaatatttttatcaattttccgagctggaaaacctgctgatggatttaatggatgcagtgggccacggcttttcggcgttagaaattgattggcattttattaacggaaaatggcaaccaaaaacctttatacaccgtccgcaatcgtggtttaagattgataaagacgacaatttattactcaaaacccctgataattacgaaggtgagccactacgcccattgggctgggtggtgcatacgcataaaactcgctcaattcagttagctcgccttggtttgtatcgtacacttgcgtggcattatatgtttaagcattacgccgtccacgactttgccgagtttttggagctgtatggtatgcctattcgcattggaaaatacggtgcgggggcaaccaatgaggaaaaacgtacccttttgcgtgctttggctcaaattggacataacgcggcgggcattatgcctgaaagtatggaaattgagctacataatgcggcgaatggctcaagcgttaataacccatttttgcaaatgattgagtggtgtcgtaccgagattgctcgcctgattttggggcaaacgctcacatcaggagcggacggtaaaagctcaaccaatgcacttggcaaggtgcataacgaagtacgccgtgatttgctgattgccgatgccaaacaaattgcacagaccattaccaagcaaattattttgccttatttacagctcaatgttgatccgagcattgatgaaagccgctgccctcgctttgagtttgacaccgcagaatatgaggatttagaaaaattcgccaaagccttgcctgatttagtcaatatcggcgtggctgtgcctgaaagttgggtgcgggaaaaattgggtattcccgaaccgcaagagggcgaagcgattttaaaaaccgttcaaagcgactttaaagaagagttaaatgatgatgaaaaagaagaaaaaaccgagcaaaaacgcaccgcacttactttcagccctcacactgactgtggttgcggctgccgccaaaccgccttgtccaccgaaaaccaaagcacggacgaacagcagattttagataatgtgctagatgagggcttgcaacaggtggattttaacgcccaacttgatcctatggtacaaaaagccgtggcgttgatgttgagttgcgaaagttatgaggaagcgggcgagaaactggccgaggcttacccagatttagaaagtgacgaacatcacgcttatttaagtcgtgcgttatttttaagcgaattattagggggcagcaatgcccgccgttaattttgctttggggcttgagccaaaagaagccattgcgtttttgaaaggcaaaaaagctttacttgaccatttggacgagaaaggcttgctggaaagtgccagagccaaagccacacgcattgcgaacatcaccagccttgaaatgaccaaagatatttatcaatcgctgatcatcgctcaagagcaagggcaatctttcggcgagtggaaaaaaggcatttttgaacacttcaaaaagaaaggttggattgcgggctatgacaaaggctatttattggctgatccaaaaacaggtgagttttttggcacaccaagacggcttgaaaccatttaccgcaccaatatgcaggcggcttactcggcacagcgttatcagcaaatgcgagataatgtagatagtcgcccttattggcaatatagtgcggtcaatgatgaccgcactcgcccaagccacagtgcaatgaatgggttggtgtatgcctatgatgatccattctggcataccttttatccgcccaatggctttaactgccgttgcacggtgattgcgttagcggaaagagatattaaacggcgtaacctcatcgttagccaaagcgaggggcgattggtggaatatgaacgcaaaatcaatcagcgagaaaccgagaaaaccacggcgtttaaggtgagtgaagatcgttgggtgatcaccgaccgagggtttgattacaacgtggggcgaacgagctataaacccaacttagacctttaccctgaaaaactcgctcaccaatttgccaaacgggaaatgagcggggcgggctttcaatgggattttcaccaatttgaaaaggaatttaaggcagctaaacaagccttaaagttaggcgataaaccgaatagtacgcaactgaccgccatccgtaaccaactacggcgggaatataaatttaccgcaggcgtattaaatgcggcagataaagccaagctcggtagccaaactgcgaccgtgtggctgtctgatgatacgttaattaagcagtttagtagtcgagaggggcaaaatttcggggctgaggagtatgcggtattgcctgagttgatttatgaacctgatatgcttttacctacaagagaaaagcatttccagttttttaaacaaattaaaggtcatagatatactgtggttttgaaagtattggaaaatgaggtctttgtgcaatcattcagaaaaatgagtgagaaacagtgggataaggcattgaaaggtagccactaggcagggctcgaacccactgcacacaatccccggtactctttcaaccgctcgtccgcgatcttcgagattcatcgcttttctagtggctgtgttgaatatacccttttttatttttaatgacaataggagatgcaatggaaacattacttaacgacaaaaattggcaggcttacttacccttagctttgagcctacaggaaaaagatgagattaaagccgcattgctgaaaaacatagcgcaaacccctgacagttttactgcgctatgtgaatacttaagatgcttacgcattattgaagaatatccgttaaaaacggaataagtaattatctatgctggatttgctcttggtatagccgtttagaaatagccaagattaattgagttaaatgctcggcggtttgctcaacctcttttgtatcattaggcagagtataattggggtgggtaatgagatcacgagctaactcaatagcgagtttatctgtattagtagttctttctattttcatcgttatttccttatttaaaatgggcgatattacccattcttagggtagcagaggcatattatgattgaaataaaaatcaataatgaaaaagaggtctttgcgttattggaacgcttaagccaaggtgtgcgttataacgcccctttaatgcgtaccattgcagggacaatgcaatcagcggtcgatcaaaactttcaggcaggtggtcgtcctaaatggctgggggtaaaatctcgctccaatggttcgcccttgattgatagtggggcgttacgcaatagcattcgtgccagttgggataatgatgaagcccttgttggcacaaatttagcctatgcggcaattcatcaatttggtggcaaaaccaaaccgcataagattaaacctgtaatgaaaaaagccttgagctttgggggtattgtgcgaaaatctgttaatcacccaggaagcaatattcccgcccgtccatttttgaccctaactccacaagatgaggcagatattttagaggacgtgcaagactattttaaacagataattaaataatgctatttagcccctaaatcgcacgctgtgcgattttttcttttagggggtacgatttatcattcaaaaatttttaaaataaattaaaacgatttaaaacggttttaaaatgggttgtgttttaaatcagtcagcttctttctatttttcagctatctctcttttccctctcctttctgttgtgtggaagcctattcacagttttagcacatcgcaaatcgctatgctatgtcaagattaagcaataaaggatttttttgatgaaacttgcagcctgtagttttgagttgagccaagccaaaaatgggcgtatccagttgttgccttacggtgcatttcgagccacagacggacgaccttttgacgtggaggcttggtatgtaacagacacaaacggtaacgatgtggtggcattggcaaatagccaacgcaacccactcccaattgattacgaacatcagattttgcactcacaacaaaatggcaaagaagcaccaagtgcggggtggatggattacctctattttaccccgcaaggtatttttgccgatgtgcgttggacggacaaagccgccgactatatcaaaaacggggaatatcgctatatctctgcggtgtttagttatgacacgcaaggctatgtacgcaaaatctttcacgccgccttaaccaatacacctgctttagatgggatggatgaggtgatggtggctgccagccaacaatttttaaccaaccaagaggaaacaccaacaatggataaagccttacttgcggcattgtgtgcgttatttaacacgccgaatgccaccgaagctgaaatcagccaaaaaatcaccgcacttgcacagtccaaaggagatagccaagtggcgttatcagaggtttacatcaagctcgctgaaaaagagcaatctgttgtggcattgaccgcacaaattgccaaccctgaccctgctaaatttgtgccagtggagcaagtcgctgccttaacggccgagttcacgcaatttaagcaaggcattgagcaaaaagaaaaaaacgcattaattaccaccgcactttcgcaaggcaagctcgctcctgcattaaaagactgggcagaaagtttaaaccttgcagcattaacggattatttagccaaagccccagcgattgccgcattaagtggcgaaccacaagccaaaactgacccgaacgaaaatcaagtggcagccttaagtgcggaagataagcacgttgcaaaaatgctgggcttaacggacgcggaatatcgtaaaaatttagaaacaggagcttaaccctatgagcgttgaatttaaaaaatcagaaatcttaaaaaaattagatacccaatttcgggcggaatttagcaaaggaattgcccatattcaaccacaatacccgaaaattgcgatgactgtgccgtctaacaccgcaaccaatacctacggctttatgcgtgcgttcccgaaaatgacggaatgggcaggcaagcgtacgattaaaaatatgtcagcggtgggaatgacccttgataacaaaaaatacgaaagcacggttggcgtaccacgtgaagccattgaagatgaccaagtgggcttattccgcaatatgatggctcaagcagggcaatcggcagcggaattgcctgatgagttgatctttaaattgttgcttgcgggtgaaagtacgctctgttatgacgggcaaaacttcttcgacaccgatcacccatactatcaagatgtcgatggcacgaatgcgggaacagcacaaagtaacattaccacaggttctgatagcggtgcgaaatcttggtatgtgctagataccaacaacgtgatcaaaccgtttattttccaagagcgcaccaagccagagtttgagggcaaatttgatccgtctaagtcagataccgtgtttatggaagatgtgtatttatggggcgtgcgttatcgctgtaatgcgggctttggtttttggcaactcgctcacaaggcgaaacagcttaacttaactgcggataatgtgatggcggttattaccaaaatgaccaccttaaaagccgatggcggggcgtttatcaatgtgcgaccaaccacgcttttagtgccaccaagtttagaaaaagcggcgttagatatttgtaacgctgatgtgattggcggcacaaccaacaccttaaaaggtcgcttacaggtaatggtatccccttacattatcgaataatcatttttccccgcctgcgggcggggcgttaaggagaaggattatggcaagaaaaaccaaagcccagaaagaaaaaacggaagcggaaaaagaaaacttagaagctaacgtgaaagatgacgcattaaaaaacgatgctgaaaccgaccgcaacctagaagatagcacgacagccaaggcagaagatgagacggtaaaaaacgctgacgaaactgaccgcactttagaagagggtgcaacagccgaggcgggcgatgaagcattgaaaaacaccgctgaaactaactgcactttagaagatgacaaggtggttgaaggtgggcaagtgattaacccgattgcttatgctgtcaagttgcgtgccattcacccgcacgacagctacgggcgttgtggttaccgtttttacaaagacaaagaaacggaaatcccagcgaacgacttaacgggagagcaggttttaacccttgcggaagatccgtggttagaacttgtgccagtgtgtgaggaatagcgatggcttatgcaaccgttgccgattttgtcttgcgtgtgggtgagttacaagccattgagctgaccgaccgcgatggcgtgggggaaattaatgagcaggtgttagaacttggactagcggatagctcaagccagatggacggttatttgtcagctcgttatgccctgcccttgctctccgtcccacaaaacttagtgcggttgtgttgtgatttaacccgctaccgccttgccagtatgtcgggagtggatattactgatgagattattgagcgttacaagctcagcctaaaagagctggaacagctagctaaaggagctatctcattagggttgccagagcttaatgcagacagtgaggacagcgagttttcaggggcgatattttttagcaacaataaaaacagggtatttagccgtgataacaaagattgaacaagccttaactgaccgcttgcaacgaggattaggcaaactggttaatacggtgaaaagttatggcggtgaatttgatgatgagagctttagcacagctcggctacctatgtgtttaatcacttatggtggctctcgcattgaacgaaaagccactagtgcaaagcgttatcaatccaccgatacctttgtgattatgcttgccgtgcgttctttgcggagcaatcaagccgcccgtcaaggtggcgtggataaacgcgaggtgggggttaatcagctcattagtgcggttcgccgtttgttagatagccaaaccttagggggattggtcaaaccgcttaagcctacggcagtgcgtaccatttttaacaatgccaagtttaacgcgagttcaattactgcttatgcgttggaatatgaagtggtgtatgacgatgttagcccgttagaagatgggttatatcccgaacctaccaccgatgaaaccagccctgattatgtgtttagcgtttatcagggggagcaatccgatcctgcaccgacattggaacatattaattttaatctttacaacccagatactaacgccgatcacccttttgtggtggcgatggaggaaaaatgaaagtaaaagccgcagttggcattaaagtgccaatggaaaatcaaccttaccgctatattgagcaagagccagtggaggttgaagacagtatctattatcaacgtcgcattaatgacggggatttaatcgtggtcaatgaaccgcgtaaccgaagaaatcgggaggcaaataatgactgatactaatatcgaatttgagcatattccaacaagccttagaatgccgggtgtatatagcgaatataacgctcaaaatgctgtgagtaccttaccaactaatgagcaaaatgtattgattattgctccaatggtcgggggcgatacggcttattctgcccctgtgccgatttattccgatattgatgcgaaaaatgcttttggggcaggttcttgggggcatttaatggctcgtattgccattcaaaacaacccgatgatccgtttaacggcaattggcttaaaagataatagctcaggcgttgcggcaacaggaagcttgaccttaaacggcacagcaacaggtgcgggcgtaattaaagcgatgattggcggggtggaatatgccatttcagtggcaaaatcggaaaccgccagcgacttagccacccgattaagtgcggtgatcaacgcgggtgaatattgccctgttacggcatcggtgagtacggcaaccttaactttgacagcaaaatgtaaaggggaaattggcaatgagattgaacttagcgtacaaagtactgcacaaggcatttcagcggaagccagtgcctttgcgtcgggttcgcaaaatgccgatcttgcctctgcacttgccagtgtggcaggctcgcattatcacattatcatctcgccgtttgctgatgataaaaatgccaccgcacttcgcaatcatcttgagcttgttgcaagtccaacggagaaaaagcctgcgattggggtgctgggttggcgtagcacgatggcagccggcacaacctatgcgagcaaaattaatgccaaccgtatcacttgtgcgtggtacaaaggggcgcttgaagcaaatgctttacttgcagcgggttatggtgcagtcattgccagtgaggaagaccccgcacgtccgctcaacaccttagagttgaaaggcttaacccctgttgatgccacgcaaacgccattaaaaaccgagattaatcaagccttatttaatgggctaacaccgattacggtggtaaatcatcgggtgcaaattatgcgggcgattaccacttacaccaaaaatcctgccaatgtggatgaccccgcgtggcttgatttaactaccattcgcacgatggactatgtgcgtaaagcggttgaacagcgtgttgccttgcgttttccgcgttcaaaactgtctaaacgcacaccgccaaaagtgcggtcagaaattttagatgtgttgtatcgcttggaaaaccaggaaattatcgaaaatgtggacgcacataaaggcaaattattagtggtgcgtaatggacaagacccaaaccgcttggatacgcaaattccaacggatgtggtgaatggcttgcacgtggtggcaaatcgtattgatttaattttataggagtaagtaatggctgaaaaatatgcaggctctgcggtgttagaagtggacggcgtagagattgagattgccgatctaaacgtaaccaaacaaacagggcgtaaattggtgaagacaatgaactccgaagggcgtgctagaggctttgccaaagggattgccacttgggaaatcagtttaaccgcagccctcccaattgatggttctgaaattgattgggcggaaattagtgatgccaaaatcactatctatccccttaatcaagaagataaacgtacctcttatttgggctgtttcactacgcaggtgggggaaaaatacaccgtagataatgaagctgtgattgatattcagatgaatgcacttaaagaggtgagcgaataatggacggacgtttacttttaggcttgcccgttgatggtaagcgatattttgattttaaggtgcatttgctcacattgggcgatgagtgcaatgcccttgagatgattgcgaatcttggtattgctacaggtgaggctaagccattaagccaagcagaaaaaatgctgatggatttagcctatttatgccaacaagtggaatttgttggggtggataaacaatatattacccctgaatacttgctaaagcgcctggcaacagatgattatctcctgattgctgagactattttggcattgcgaaaaaagcatatcgccgctggggagagccaacaccaagaaaacagccacgccccaactgctatgacttaaaggcggcagagcaacattatcgaagtgcggtggtttttttagcgaaattaggctttacgccccagcaggtgcgagaaatgagccatttagaggtgtcggcttgggtggaaagtctgttgcaatctcaaggggcaaaatcacaagcgaatggcataagcaaaggcgatacagtgcattacaaccttgtacgccgcaggcaacaacaagaggcgtaagcctcttttttttatgggtttaaaacaaatttaataagggtttaaaaatggcaaatctaaaaatgtctttatggcttaaagctaaagattttgcaagtggcgttgtcgataaaatgcgtagcaatgtcaataaagcgaataaagatattgaaaatcaagcggtgcgaagcgggcaaaaacagcaagaaaccgtaaagcgtacggctcaaattaccgagcaatcttatcgccaaatacagcaagctgctcgagcaaggcaaagtttgggaatgcggagtgaaaatgctatccagcgtgaaattaatcaaaccattgccgcttatcaacgtttaaaaaccagtggtgtcgcctcaagccgagaaattgcccgtgcggcggtaatagctaagcaaaaaattgcccagcttaatgcggaaatgggcaaagtgtcgacagggcaacggttggggaatgttgttggaaaaaccatggctattggcggagcggtttatggcgtagccagtacattaaagcccgcaatggataataaaaagcaatgggatcagaatgttgctcaagttgcattaaccgccttcaatgatcaagatgcggattatatcaaaacaacaggtatcgcacgcgtaaataaagcagcatatgaaacaaccaaagccgttggtgcgggaaccacggatatggcgttatccgcattagatggaatgattaaaaatggtttatcttttgaccaagccgaagcaacattgcctacagcaatgaaaatgatggttgcgggacaaacagacggtaatcaagtgggtgcacttcttcaggtcttgaaaaattatggctttaagggagaggatttacaaaaagccttagaggttactttgcaatctggttttgatggtaagtttgaggtgtcagatatgatccaacacctacctaatttgctttctatttctaaaaatgcgggctttcacggtttagaagattacaaatatttactttcaatgacacaggtggcagctaatcaagcggggtcaaatgatattgctgctaataatgttgccaactatttgaataaattaaatagtgtcgataccgcacaacggttaaaaaaagtggatatttccaataaaaaaggtttgcaaggcattgatttagaaaaatcctatcagcgtggtttagccagtgggaaaaatgcttcacaggtaatggtaagtattgctgaaacgttgcttaaaaacgatcaggaatatgtgaagttacagcaaaaactgttgcaaaccaaagatgaacagaaaaaagagcttatcaaagcccaaatggatttaaaaaaaggggcggtgcttggtaagttgttgcctgatgtacaagcaaaagcagggtttaatgcggtaacaacccagcaagaaatggataagtatcaagccaatcttgaggacggcaaaattggcaaaaatatggataaatctgtcaaggtgcttgctggaacggatctagctaaagaagagctagccaattccttaaataaatttagtcaaggcgaagtcaccggctggttaaatagtattgaacgtaaaattaatgacgaagtgatttctgcacatcaaaacggcaacgggcaaatggtgggtaatttaggcttagcaatggatgtgggaaaatcagcagtgggctatggttttggtggctgggcgttaggaaaaggattatctggcggtttggggcgagcaggcgttggtgcggcgacgggagcaggtttaggtgttgtacccgttttaaaagcggtaggtaaagtgggcgttgttggcacaatcgcaagcttaactacatcacctgaattagatagtaaatctcaacaacttcttgatttacaacataaagtacgttcaggaacagccacagaggaagaaaaacaagcgttaatgcaacaaattaaccaatctagagaagaagcaaaattacaagacgcactttataacacaggtaattcacttggtgcgtattttacccgtaaaagtgtagaaaagtcttatatggcttatctcaatagccgtttggaaaaaggtgatatttcggaagaggttcgggctcaaattgaagaacgaaatgcctattatcagaaagagcaggcaaattcatttcgttttcgtaaaggatcaccttatgttgcttcttctcattttagtgagcaagctgatcaaagtgcgactcgcattgcaggccttagctcgcctatcggtttgacaatgccaaccgcggagggaggaacacttgcaaaacttgagcccgccttgtcgaacttagccaattaccgagctgactttgagcaatttgggcaaaccttgagtgatgccttaaaacaagccattgagagccaaaattttgtgatccaaaatcaaattaaggtggatttagatggacgaattgtggctgaacaaacttcagaatatcactatcaagatttaaaacgttgggggtaaaaatgaaaggttggacaatgcctattcaacgcgccagttatcgtggtgtgcgttttgaggtgatttcggtagatgatgaattaaaccgtgccaccattgatcacgcctacccttttgttaatggggcggatattgaggatttgggtttaaaccctcttacggtacgaatgcaagcagtgttttatggcgagggctattacacggatttcaagcagtttttaagtgcgttacaaaaacaaggggcagatgtgctagtccaccctattcggggtcggttgccgaatatgctttgcacttcggcaaattttcgccacgatgcggaaatgattgattatgtggcgttagatttaacttttgtagaaagtacacctgccaagccgatttttgtttttgagttttcttttttggctaaaattgatgaacttttaacacaattggaagattttattgatgaggtattagcgttttttgctcaaatcatggaggtggttgcctttgcgatgaatgtaaaatcacgtttattaggggcttttggtgcattacaaggttgttttgaacagctttgtggtttatttgatatgggcaaaacttttttttcattgccttctacatttggtgcaatggattttaaagcaaaatcttctcataccgctaaagcaattacacatattatagagcaagggctaacccaagttgctcagcgttctgatctcacaactaaagcaaaatttgatgaaacaataagaacggtaaagcaaattcaagccattcctcaaaatttactttcaggtaaaaatatgaatttatcgcaacaacaggggataaaatcattaacaatgtcattgtcaactgaaagtattgaaccagtgcatttgttgatgcaattaacttgtacagcgacgttaattcatttggcaacggggtttattgaagacgaaacattattgccgcaagagattgactatattacaacccttataaggactcatattgtgtcaaccttgcaattattgcgtcatcaagcccaaaaagagcaagcaaattctgcactaaattcaaccgcacctaatactggggtttataccgctactcagcaaattgcggagagattacgaactttatcccatcattttacccagcttgcaatttcggcgattaatcgtaaaccaccattaacggttagggttgtaccatttaatggcacgattcaacagatcgcccatgcgttttatggagattatcgccgttccgatgaactgctacgcttaaacccacaagttaggtttccgaattttattgctcagggggagttattaaatagttatgtcaattaattatccttatgaaaatgatgtggtggttgaaattgcgggacagcagcataaccactggaaaagctatgacattgacagtgattttttaatccctgcggatgcctttcgttttgaaatcggcgtggcttcagagcatacccacttacccgatttttcggggcaagaagtaaaagtgcggatcaatggcgaggtggtgctgacgggcattgtggacaccacccagcacgggattagcaaaacgaaccgcacttttagcctaaatgggcgagataaagccagcattttagtggattgctctgccccgataaccaatgtgaaagggctaacggtgcttgaggcggtgcaaaaaattgtgaatccgttgggtatcacaaaggttgagcttaacgccgaaaataatcccactttagataaagtcgatattgaagtgggcgaaaccgcgtggcaggctgctatccgttgtgctaattctgcggggctacatttatggtttgatgcccaaggtacgctaattgtgggcggtgcggattactccacaccacctgtggcaacgctatgctgcctaaaagatggtaaacgcaataattttgagcaagcagagttgacctatgatgtatcacagcaatttagtgagatcacctttttagctcaacgccacgggcgagctggggacgataataaaaacgatttaaaatgggtgtacaaaaacgaggcgatgaccacttataagccgaaaacggtggttgtgcctgatgtggaaaatttggcagcgttgcaaaaatgggcgaaaaaatatctctcagacagcattttagaaggctttacgctaactatcattgtaccagaccataaaacccaaacggggcaattatggcaaccgggtcagcgtgttcacgtgatttgtgaagaatatgatattgatgccatctttttcttgataggacgacgttttaccctttcccgttcaggcggtacacaaaccgaattacgcttaaaacaagatggagtttggacacccgatgcttatgttggcaaagcggaaaaagcccgcaaacggaaaggtaaaaaaggtaaaaatgggccgttaatggcaacaacaggtgatggtaaatgggagatagttaggggtaaataatgcgtcgatttagtcaagcaatacaacaaaccgcacaaacgacattaaatggcgtgcgtcaggcttttcgtggcgtgctaaatttagtaaacagtgcggataatattcaaaaaacgcaagtatcagggctagctgacgagaccttgcaagatgtggagctaatgcagcattttgggtttacctccgttcccccagctggtacgcaagcggtgattattcccatcggtgggcaaacctcgcatgggattgtggttgcaaccgaaaatggggcgtttcgggtcaaaaacttgcaaggcggtgaggtggctatctacgaccaaagtggctcaaccatcgtgcttaagcaggggcggttaattgaggtggattgtgatgattttgtacttaattgcaaaacctatcaagttaatgcgacaacgggggcaaattttgatacgccaaagttagagaccacgcaagttttaaccgctcaagggaaaattaatggcaacggtggtatggcggtgcaaggtggcagcggggcaacctttaacggtgatgtgacgcaaatcggtggtaacattacgactgatggcgatgttaacgcaagcggcaagtctttggttaatcatactcacagaggggacagtggtggcaataccggctcaccacaataaatctatttacaacaataaaaagcggtgtggaactccatcaccgctttttttgtatctgttttacgtatatttgtcagtatggacagagagttaagcccgcttactggggactatacaagtaagacaatcagtacgctcgctaatgcggcgtatatcagattaaccacacctttaggctcttggtgggcagatgggcgtgtaggctctctgctccacttaattcagcgtgaaaaagacttaacccgtgttggacttatcgcccaacaatacgccgaagaagccttacagcccttgcttgatgatgggcgagcaagtcaaatccaagtaacgcaccagcaaccacataatggctggttaattttacatattgaaatcattgataatcggggtgaaacatatcgctttaaacaccctgtaaaagtcatttaacgggagtttaaaaatgtttgttgtacccaccttagatgagataagagcaagcattttacgcgatatgcaagcccttgatcctcaagccgatgtgagcgtagacagtgataattacgcccgtgcctcaagtttagcagcggtggctgaaggtatttatgcacatcaaaaatggctgattaaacagttttttccagataccgccgatacggaatttttagagaaacacacgggattgcgaggcattcgccgccgtaatgccacctatgccagcggacgaggggcaaccattacggggcaagaaaatgccgagatccctgcaggattgcaaataaaaacggaagataaccgcttttttgagaccctagaaagtgcggtcatttctagcacgggttttgtggttgtgcctgttcgctcccttgctacaggagcgggacaaaatattaaaacccaaaccaaaggcagttttatggctgccccagttggtgtgcaaagtgaagtgatactcaatgaagtcattggtgcgacggacgcagaaagtgatgcttcactgcttgagcgtttgcttgagttgatccgccgtcctcctgcaggaggcaataaatatgattatcgcaattgggcgttatccgttgatggcgtaacggcggcttatgtgtatcccttgcggagaggattaggcacggtggatattgccattacggcagacaatgatgtacccaatgaagaaaccattcgccgaacacaagcctatattgatgatgtccgtcctgttacagcgaaagaaagcaaagtggtaaagcctgatgtaacgaaaatccattttgatattcaggtcaaaatcagcggcattacgcttcaagagataacgtcagcaatacaagccgcattggctgattattttaatacgctaatccccggtgatagcttgattgtgtcgcaatgcgaggcagtggtgaataatttagtgggtgttgtggatcgcaaatttattaccccaactgcgaatcgtaccgctgacgttacccacaaaattgagtggtttagattggggaacgtgaatgtgtcggagatgcactaatggctaatgattacaaacacgcccttgctcagctctatccgcctgtttcctacaatattaacggtaaacaatttttagcccaatgtgaggttgatggaaaggtttttcaacgtttagaacagcgtgcaacggaagtgttaaatgtgattaaccctgaaacttcggggcaaatgctcgctgattgggaacggatttgtggaataaaaaccgatacccaaaagacctacactgagcgagtgaaacgggtcattttgcagcttaatgccattggtgggttgtctatcccctattttatgcaactggctcaaagcattggctatcaaattgagattaaagaattttcaccattgcaacaggatttgcctgttcccggtgacattgtgcaatttagagacgaaccgcaagaaagcctgatttttatgtggcgagtttctgttttaaatggtgatgacaatattgtgtattttcgagcggggcagtctttagcgggtgagcgactagttgagtttggcgatcccattattgaagccttttttaaagagttaaaacccgctcatacttactgttattttgcatacaaaggttaaaaaatgaaagatttactccctaaaattgatagccaagatggcgaatttcaaaatggcgacccagccagtggcacacaaggcacgcgggtaactgccgaatggttgaatagcgtgcaggctcatttgcgagatgtaggcgaagaggtgaaatatttgttattacaagcagggcttacacctatcccaagcaaaaccacacaaatttatgaagcgattatggcggttattaatgccaaccgcagaaatggcaacacaacccaaaaaggggaaatccaacttaccgacagcatcaatatggcatcaagtgtgtttggggcaagtgcgttggcagtaaaaaatgcctatgacaaagcggttgaggcggataatcacgccgaaagggcttgccatttggctgaaagcaarcaatcccctgcmacwacattagcyggctatgggattggtgattttaaggtggggacatccaccggtgatgccaatgattgcaagattgacggcaattattattttgccagcgggcaaaatttaccgagtgcgggggcgtggcatattgcggtgatgagtggcggacaaactaacgctatccgacaaattgcccgcaaagccaatgagagcaaggttcaaacccgttattttaacggcacgtcttggagcgcgtggaaagatgtaggcggtgatggcttgcccgttggctcagtgttggcatttcctgtagccgtgcaaaatccacaaggttttttgaaatgtgatggctcaacctttgggagaacaacctatcccgatttataccgcgcgttaggcaatagcaacaaactgcctgatttacgccgctctaatgtgggaatgacggcgtattttgcgacagataagattcctgakggctggattgcgtttgatgaaatcaagsaarargtaammaaagagammtaccctgagttgtataaatacctgattgaaaaatataccagtatagacaaygtyccyaaagcggaagaccgttttttgcgtaatgctcatggtgagttgamagtaggagatgtacaactcggttccttaatcggtrcrgattcgayagacggaaacggggcattttcgccttatgtgaaagctattmaaarcacttaccaagaaaccgttgaccaagtaggsttcgatccgttgctgatagargamattggaaacggaagarscgytgtyaataacgaacrttcycckgayggcggacaacctgaaaccaaaaaacaatataacgcygggctttcgtggtcggtaggarcggrcaraaatrmmgacctkaatsamccaatcmaaaataayrawastgrcaayggtcattttrtcggcgtwactcgcccgaaatcccttgttttaaaactgtgtatcaaggcgaaaarcagttttgatgaggtggtrttttggattaargcrttyggtgcggtggaaaatcaaggtgttttggacgcctctgctatcgttcaagaamtgcaggattttaaacrgcaagccgaggaaaaaatacaakmmattacmktgcagaaagaagarattatgcacgctatacaagaggagatgggraaatcagattattcccttgttaaggtttgggaggggaagaatatatatacagagggttcaataaatttaagtgaaccttgttttggctctactgtttttctgtttgcttacgctgatagagactatccaagggaattagttgtttttagttttgatgttcctgataaacatattgatttaaaaagaaaaaattcagatcaatacacattctatggtattgctcattacacaagaagcggtggtcatgatgcatctcttacacatgctaagattaacattaaccgaaaaacaggagatcaaatcaaatttgaggatttttatgcgggatataatatttacttaagagaaatctatatyaaaaaaccaaacaacaggaaagcacgatgaacatttactttcaaaaacaacaaktaagcaattatcaaatttttccaatccctcaggatrtagagaattggattgaaaaagacgttraygaaaaggaactggaaacgcatgtwttrgtggaatttaacggcgagtatcaatgggtcgagaaatccgcygacccgatgacgaaatggaacggsaarmmatgggtcgttgatgaagagaaaatgaccgcacatttarcccaagtgcgggcggaaatgcgagagaaaatcaatgcsttgcgagatgaaaaaatyaatggcggggtrtttgtggaagcggtgggcaagtggattgatacggacgctacggcggagcggaatatcttatccgtcaaagccagttatgatttattcggygatatggarattgcgtggacttgtgcggataactckgtwttgatgatwaayaargaaaaattaatgctgatttggcargcgttaatgaaygctaaaacaggtaatcatgctaatgccttgaagcataaaaccgccatggagcaatcggacaatccggcggaatatgattattcsrrcgggtggacaaaatgytatmasgattatttagcggaacaaggcaatgagtaaagtctatttagcactgtataagggcaacggtggcagtttgtatgaccgagtcatagactggctgatccgaaaaatcactaaggggcaatatagccattgtgaaattgccattgagcaaacggcgtttttaagtggcgattattatccgtatatcacctacgattgctacagttcaagtcctcgtgatggtggtgtgcgacacaaagtgattgaccttaaagacggcaaatgggacttgattgaactgccaaacatcacggcagagcaggtcaaacgctactatacccaaacccaaggcagaggttacgattggtgggggatgttggggattgcctttggtatccagcaaaaacgctcacgctacttttgctctgagtggtgttttaacctaatcaaaaatggtgacgagggctggcggtttagtccaaatcatttagcggcgatttttagacggggagcaaaatcagattattccgcacgaagttgatattatttgggaggggcaaaatgaagtaaccgtttagagcaaaagaagaagcggcgatgtggtaggctctgacctctaccacatcagcctaagcagatagtgcctgcatagacccgagaccgctttgtctgaccagacgggcggattgtaacaaaaccgcgtaaagtgagaaagtctatgcaaaaagatttgcaagaaatacggtgcaagtgctgtaaaaagcttcttgcacgcacaaaagataatcaatatttagaaattaaatgtgtgcggtgtaaaaccttaaacacatttaaacctactcgttaaacaactcagagtgtccgaatgccttgagcgtcagaacgccataatttaaggataaattatggcaaacaagaaaatcattgtttgggcgttatttgatagcggcaatggctgctatacccaagccgcccaaccattccctaacattgaaatctatcctatcggcattgatattgagcgtaaaaatcggcattttttaccgctgaatttagcggattttggtcggttgtttggtgataatacgctgtttaatcagctagatagcctccctaaacccgatgtcattttagccagtccgccttgtgagagtttttccgttgccaactctattaagggcgggaatgtctgttggcaatggcagggaaatacacgctttgctattcgccgtcgcaaagattttgacgcggcagcggttaaaaagcgacgttatcgttatgagacctcttttttgaatcgaattaatggtgagctttgcatttataacaccattgagattattaaacggtatcagccgaaaatttatgtgattgaaaacccttatgcgagccgcctttggcactatcttgatgagattttagcctttcctcttccttatgcgaaccctacctattatgggaattatggctggccctgcaaaaaggcgactaagtttaaaagcaatattccgctaaatttgcgttatcagcattatatttcgggcaaaacgatgtttgactgtttacacagttataacgcccgttcagccattccgttgccacttatccacgatatttatcgtcgtattattgaggtgttaggaggtaacgatgcgtcattttagtcaagcaccgttgccgtttgtcgggcaaaaacggmtgtttttaaacscctttaaacaggttttaaatgacaatattcaaaatgatggcgaaggctggacgattgtcgatgcctttggcgggagtgggctattaagccacgtagcaaagcgaataaaacccaaagcacgggtgatttacaatgattttgatggatacgcagacagactaaaacacataagcgatacaaatcgtttacgagctgaactgattcaaattgttggcgatattgtaccaaaaaacaagcgattagacgacaataaaaagcaagaaatcattaataaaatcaatgattttaatgggtttaaagacctcaacaccattgcaagttggttgcttttcagtgggcaacaagtcagctcatttgaggagctatttagcaagacattttggaatggaataaagctggctgattatcctagtgcagaggattatcttgatgggcttgagatagtcagcgagccatttcaacagtttctgcctaagtttgccgacaaccctaaagccttgtttgtgttagacccaccttatctttgcaccaagcaaaacagctataaaatggcaaattattttgatttagtagattttttgcaacttattggcctaacacgaccgccttatgtgttttttagctccactaagtcagagtttgtgcggtttattgcgtatatggtgcaggcgaaaaaggataactggcaagcctttgatggagctgagcggatagtccttcaaacatcgttaaactatcaggttagctatgaggataatttggtgtttaaattctaaaaattaaggggcgaacgcccctatttttcaatgcccgccttatagcctgcctcataagccgcacgcatgaggcgtttgatattccacacgcccatatcataaaaatctaaatggtcactcattcgggtctctaatgtttcaatatcccccacctcttttgcaatggtttctaatatttttgcgatggttttttcagttgtttttttcattgcttattctcctcttaaaatgtttacgattttgtcagcgatttgctgggcggcaatgtcaaagttagtctcgattgaaacgcgttggcgacaatgttcagagtgttcaaccagcgtgccttgtggcatataaagtaaataaattgttggctcattttgataactatcttgacagacttgaaagcggcgtttcccttgcacaaattccccatttttaaagccgtgatggttttcaagtctggtggttaagtgttgaataaatgctcgtgtattaaatttcatttttatgcccctgttgttttgtgttggggacatcattgctcgttggggacgaggagtaaaggggaaataagcagtagttaagctgactgactaacaatgtagctggggaggtatggaggtctaaatgataaaaaatttgaaataattttgcataatctgagactcaatagctatgcaaaataaatttaaattttatgcgaaatgttttgcgattttataatttctccaattgttaaacgtggagacagtgaattgaaaggatcttgaaaaacaatctgcatgtcttttttcaatgcttgagctttttctttcgataaagtggcgatattttttccgttaaattgtaatatcccctgataatcaagaatttgcataatagcacgtcccaacgttgatttacctgaaccggactcaccaacaataccgagggtttcaccgacttttaactcaaaagaaatatctttaacagcatggaaaacatttttcggtttaccgaacaatgtgcgttttagcacataatcaatatgaatattttgtccattgaggaggacaggtgcattttcagccaacggatgttttaaatccgtagggataggcgtcagtaattcttgtgtatagggatgatgaggttggttaaatacttgttctgtattacctcgctccacaatttcaccgttttgcatcacacaaacgtaatcactgtaacgacgaactaaacgcagatcgtgtgagatcaaaatgatcgccattcctatatctcgttgtaattcaagcattaaatcaagaatttccgcttgcgttgttacgtcaagtgcggtcgtcggctcgtccgctattaataaatccggtttattaataattgccatcgcaatcatgatacgttgtaattgaccgcccgaaaattcatgtggatagcatgtcattttcttttccgcttcgggaattttcacttttttcagcatatccaatgcgtgcttataagcctccgctttactcattttcggatggtgaatggcagtcgcttccgcaacttgttcaccaatcggcaaataagggttgagtgaagtcatgggttcttgaaaaatcatcgccatgcgatcaccacggattaatcgcaactctttttctgataaagataatatttctttgttttcaaataagatttttgagtcttcactgtaactgatgattttttgcggcaacaattgcataattgccatagaagttacagatttaccggatcctgattcgcctacaatagcgagagtttgtcctttttctacctcaaaagaaatattacgaacggcgtgtacgacttcttcatctgtttttagataaacatttaaattttttacatcaagtaatttcattctattcattcctatttatcttttggatcgagggcgtcacgcaagccgtcaccaataaagttaaagcaaaataatgtcagacaaaggaaaaaagcaggaaatgcaatcaaccaaggcgatgtttccatttgtgcagctccatcgctcagtaaggctccccaactgctcatcggttcttgtgtgcctaaacctaagaaactgagaaaagattcaaataaaatgagcgaaggtacttccaacgaggcataaacaacgacaattcccaaaacattcggaataatatgtttccaaataatttgacgacgggaaacaccacaaacaatagcagcctcaacaaattctttgttttttaaactgagtgtttgcccacgtacaattcgagcaaggtttaaccaagcaatcataccgatagcaacaaaaattaagaaaatattctggccgaaaaatgttaccaacaatataacgaaaaacataaaaggaaaagaactgagaatttctaatgtccgcatcatgacaacatctacttttcctcccacataacctgagatagcaccgtaaatagttccgatcatcacagcgataaaagcaccagcaatgccaaccatcagcgaaattcgcccacctatagcaatacgcaccaataaatcacgtccggaagcatctgtcccgagataatgcccggaaacaaaatcaggagcgatactcatcatattccaatcagtgtcatcatagctaaaaggaattaacattggtatgaaagtaataaatagcaacatgcaacaaatgacaatcaagctggcaactgctgctttattacgaaagaaacgacggcgtgcattttgccataaactgcgtccttcaatgacgctctcacaagcgttttgcatgatattttcttccgattttgagcggttttgacgattagacaacatgagatctccttatgaatagcgaattttcggatcgataaccgcatatagaatatcaactaatgcattaaaaaagatggtaagcgtccccactaatatggtgaggctaagtactagagaataatctcggtttaaagctccattgacaaacagctgccccaatcccggcaacccgaatacactttcaatgaccattgaaccggtaataattcccacaaatgccggtgctaggtaactgataacaggaagaagagccggacgcaaagcatgtttgaaaataatttttttcaatggcaatccttttgctttcgctgtacgaataaaattggaatgcaatacttcaatcatggaacctcgtgtaatccgcgcgataccggcaacgtaaccgatagtaagagaaagaacgggtaaaaccatataataaagttgaccgtcgttccaaccgccggcaggtaaccactttaaccaaatggcaaaaaataacactaaaagcggtgcaaaaacaaagctgggcatgatcacccccgtcatcgcaaaccccatcacaatataatcccagcgactgttttgtttgagagcggcaaatgtgcctgcaactaagccgataatgactgagaaaataaatgcgacaatacccaatttcagtgacacgggaaacgcagaagcgattaaattatttacgctttgatctttgtatttgaaagaaggtccgaaatcaccttgcgagagatttttcaagtaaagcaaatattgtttaaagagcggttcatttaagtgatatttcgcttcgatattcgccatgacttctggaggataagtccgttcggaagtaaaaggactacccggagccaatcgcatcagaaagaatgaaaatgtaattaaaataaacaatgttggaagtgcttccattattcgttttacaataaatttcaacatcaagaactccaaacagattaaatcagaaaaagtaaatgttatttaaaaataaatcgtcaaattcccctaacctaatgttatcaattagggaaatttgacgggataaataagtttaatgtttaataatataaagatttctcaataaaataatatcttgaggatctttaccttcatagcccttaacataaggtttcaccaaacgcgggttaacatagttatatatcggtatgataggagcatccgctgccaaaatcgcttcggctttagcataagctttcatacgatctgtcgcctcggagaattgataagactcattcaccgcttggtcgtaggccgagcttttgtaaaacgctaaattgttacttgagttggagagaaaataattgataaacgttgtagcctgattgtagtcagccgaccaaccggcacgtgcaatatcaaattgtttgttgtgacgactttcaatatacgttttccattcttgattttccagtttaacatcaactaaaccacccgtattatttttccaaattgatgccgcggcaatagcaacttttttatggttttcattggtgttatataaaatggtaaatttcaatggattcgatttactgaaaccggcttctttcaataattgaacggcttgctgattacgctctttcattgataatttagtatattcaggttgctgaattgcaccaccttccgcaatataggtcggtgtaaacacgtatgtaggtatttgcccctgtcctaataccttatctgtaatgatattacgatccaacgctaaattcagtgctttacgtacccgtaaatcattaaatggtgctttcgtattattgatctcatagaaataagtacccaatgtacgtgaagtaaacacttgatccggcatttcagcttttaattttgggaactgctccggtggcaaggcatgatctgttatctccacttctcccgcacgataacgttgcacatccgtacttggattttgaatcgctaagaatgtcgctttatcaatcacggtttctttatcattccaataaagcggattgcggacaaattcaattttttcgttgataacgtgtttcgtcaatttataagcaccgttacctacgtaattttctactttgacccaagcatcaccgaatttctctacaacatgtttaggcaaaggtaagacagagtgatgtgtggtcataccaggtaaataaggcactgaattgcttaacgttaccacaaaagtataatcgtcaacggcttttacaccgagagaatctacttttttcttcccttcaataacatcttgtgcattttcaatttgcatgtacgtcaaataagaagaataaggagaagccgttttcggatcaacaagacgttgccatgcaaagacaaaatcatgggctgtaacaggcgtgccgtcagaccattttgaatcatgacgtaatttaaatgtccattgcttaaagtccggcgtactttcccacgaagtggcaacaccaggctgaggattaccgtcagaatccaccgtaataagtccttctaaaacctgtaaaacaacctctgcttcaggtattccttctgatttatgagggtcgaaactttgaggttcagctccattattgatgacaatttcttgctttttagccaacacggtaccagccggaacattggctgcaaaagcagatattgaaaaacctaatgccacggttgtggcaacaagagtgcgggttaatattgtgtgcattgttattctccattgtgattgttgtttgctctgctattaatacatgaaaagattgcttttgtaaataattcatactagttagatagtaagctaattagagtgaattattctagagggcaatgttacatgaattaaattcttaccataataaagtgcggtcatttctctaagtaaagatcgctgagtaaatagccaccttgcggtcttttcccttcataaccttttaatttcggatttttaataaataatccggcgtaatgataaatcgcgataaagggatgatgtttgcctaattcttcttcagcttgtgcataaatttccgctcgtttgttttcatcactttcgttgtaagatgcttcaattaattgatcaaacttttcgcttttaaagccgattttattttgcgaactattggaaagaaaatatgtcaaaaacgtgcttgcttcgttgtaatccgcagaccatgctgcaaatgccaagtggtaatttttctgattttttgtatctaaaaatgttttccactccatatttttcagcgaaatatcaaccagaccgtctaaatttttcttccacatagaagtaaccgcaatagcaatattttttagtccttcgttagtgttatacagtaattcgcttttcaacggatttgctttactgtaaccggcttcacgtaacagctttttagcttcttcgtttcgttgtgcttgcgtccaattagcatattctggttgggtgattttttctcctgcatgaatatagaacggtgtgaaacggaaagtaggtgtttgtccaaagcctaatactttttctgtaataatgttgcgatcgacggctaaatctaatgctttacgtactttaatattatcaaaaggcggttttgtcatattcatttcatacataaacgtacctaatttacgagagctatagatttgcgaatcgtattgagcacgaaatttaggatcatgataaagtgattgaggaatataagctatatccaattcgccggaacgataacgagctccccctgcactttccgttaaaatataaaaagtagctttattaataacagaatgggcgttatcccaataggctggattacgttccaaagtgattttttcatttaacacccgttgtgaaattttataagcaccgtttactacaaaattttccggttttgtccaatcatcaccgtatttttcaacaacagcacgatttactggataaagagaagtatgctgcgtaagaaggacagcataaggtacgggtgcatcaagggtgagttgtagtgtattatcatctaatgcggtaactcccaaaaattccggtgatttctttccagcaataatatcatctacatttttcattttcatgaagccaaggtaacttgcataaggtgatgcggttttcggatcaacaagacgacgccaagcatagacaaaatcatgtgcggtaagagaatcaccattagaccacttaatatttgggcgtagataaaaagtaacggttttaccgtcagacgaggtatcccagcgataagcggcaccgggaataatattaccgagttcatcggttttcaccaatccttcaaataattgttcagctattaaaccttcccccgatccttctattttttgtggatcaagggtagcaacttcagcagtaatttgaatactgatttcctgtttatccgccaattttgtaccttgaggaacttgtgccgaaaatgcgactgaagaaccgacaagtagaaataagcctaaaagtgcggttctatagtttttatattttaactttgtccatatattgtgttgcataaattttatccttttaagtaagattaaaataataagattttcattggtaaaatatttatgcgatgaagtaaagtatttttacaaattttttgtaatttttaattagcaacctaattactatttttgcattttcaaaaatgtaggagtagaattccgacatcttcaataattcatcataggtggtatttatgcaattgagacgtaaatacatcgcctcgtattgataggagcagtatatgcaatttgcgattatcggattaggtaaattcggaaaatcagttgcacgagagctgtataagctgggtaatcaagttgtaggcatggatattaatgaaaaaaaagtggagcaatgtagccattttcttagtgcaagtttaatccttgatgccacggataaaacagccttgcgagaacttaacattcaagagtttgatgcagtgttggtcagtatcggtgaaagtctggaaagcaatttactctgcacacttaatttaattgatctcaaagcaaatcaaatttgggcaaaagctaaaaatgcggcacatcacgctatactttccagtttagggattcaacatatagtaagacccgaaaatgatatgggtattttagtcggtcaatctatgaattgccctagtgtaacccactgtattccgctaggctcggatctctttttaattcatttccttgttcaatttcaaactactgttaccctcggtatgctgaaaaaacgctataaagatattgttattaccgctattcaacgaggagaacaacttattagcaatccggatgatgaaactgaaatacatcgtcaagaccatttgctgatcattggctatttaaataatctccgcactttaaccggcgaattaaataaaatccaaaatgaaatttgaacatatcaacacaaagccaccctatgtattagcgggcggttttctctttatcattttaatcggcacattattattggaattaccctttgctcaccataaaagtatttcatggctacatgccttatttacttcaacatcagcggtaacggtaacggggctaagtgtcgaagatacagcaaatttcaccctattcggacaagttgttttaatgtgcttaattcaaattggcggattgggatttatgacgtttgctatttacatagcaagacgaatgggtgccagaattggcttattcggcaatgcaattgctcaagaagcactgggtgatgtgccttttaatttacttctacatactgccaaaaacgttctaaaatttgcactgacttttgaacttatcgcaatgattattcttactgttcatttttatggtgatgtttctttttttcaagcactgtatcaaagcctgttttacagtatttccgcttttaacaatgccggttttgcactgagttcagaaagtttaatgccttatgtagatgatattattgtcaatatagtcatcaccgtattgattattattggcggattgggatttgtggtacttatggatatcaaaaatcaatgccaatataaaaaattctcactaaatacgaaggtagtactttgggcaacctgtattttaaatatcgtttcctttctaatattttatattttagaacgacaaaacccgttaacatttggaccgctaagcgaaacaggtaagttgtttgccgcttggtttcaagcgataacaccaagaactgcagggtttaatactgttgatacggcaggattaactgatgccagtagtctgctgactatgttcttaatgtttattggcggaggttccttatccactgcaagcggtataaaaatcggcacattctgtattatagtkgtagcgacattcgcctatttacacaaagaatcccatgtcaatttgtttaaacataatttgcctgatgaactaatcaaaaaatcctttgctttattttttaccagccttagttgtattggtattagtagctttttgctcttggcagttgaaccgcaatttcatttccttgatgttttatttgaagttgtttcggctttaggtacagtcggactttcacgaggaattactgctgaactttcaccgttcggagagtcaattttaattatcttaatgtttatcggtcgagtaggattgctcactatgatttatctcattatgcaaccgcactccagtaaaattaaatatccaaaagaatatatacaaataggctaaaaaataaagggaataatttattcccttattttcctaaatttaatctgttttgcaccgcactttgctcaagtttaacgacaaatatacaaagtaattttcctctaagaatgaaaaaatttatgctaacaaagccaaaaactcattttcactcagaatgttaataccaagctcagtggctttagttaattttgaccccgcactttcccctgcaataacaaaatccgttttactcgaaacactgccgctaactttacagcctaattgcaacaaatattcttttgcctctgaacgccccattttcgtcaacgtaccggttaatacgacggtttttcctttcaaaggattgtcccgcacctctttaacttcaacgtcgtcccaatgaatgccttgtgcaattaaatcttttaccacagcaacattatgaggctcagaccagaatgaacgaatacgtttagccactacttcaccaacatcttgtaccttttgcaattgctcaaacgttgcattttcaaaagcctctagtgtcttaaaatgagttgctaaatttaatgcagtagtttccccaacttcacggatgccaagtgcaaaaataaaacgagccaatgtggtttttttcgctttagctaaacttgctaaggcattttctgccgatttcgcccccatacgctccaaacgcattaaagtaacctgatctaatttaaataagtcagccggtgtatgtactaactccctttcaaccaactgttcaattaattttgcaccaatgccgtcaatatccatcgctttgcgtgaaacaaaatgtttaagtgcctctttgcgttgagcagcacaaattaagcctcccgtacaacgagcaactgcctctccctcaattttgctaataacggaatcacacacaggacaatttgttggaaaaataatagattttgcattttccggacgacgttcatgtaacacgccgataatttgcggaatcacatctccggcacgacgcacaatcacggtatcaccaatcgcaatatccaaacgtgctatttcatcaccattatgtaaagtcgcattactcacagtgactcctgcgacaaaaacaggttctaattttgctaccggtgtaatggcaccggttcgcccaacctgaaactccacattattcaaaattgtcagctcttcttgtgccggaaatttataagcaattgcccagcgaggtgctttagaaataaaaccaagttgttgttgcaagtcaatatcattaatttttaataccgtgccatcaatgtcataacctaaggaactgcgtttttgcttaatagtgcggtagaaatccaacactttttcaatcccatgacataattgaatttcattatttaccggtatgccaatagattttagccattgtaaacgagcaaaatgtgtatccggtaattccactccttctgcaataccaataccataagcgtttaacatcaaaggacgttgaccggtaattttgggatcaagttgacgcaaagaacctgcagccgcattacgtggattagcaaatgttttttctcctttcgctaaagctgttttgttcagtttttcaaaacctgcttgcgacataaaaacttccccacgcacctccaaacgagtcggtggattatccgttaataattgcaatggaatattacgaatagtacgaatatttgccgtaatatcttcaccggtcgtcccatcgccccgagttgcagcctgtaccagctgaccgtttatatacaaaatactgactgccaaaccgtctaatttaggttcgcaacaaaatgttaaagaatgatgaacatgtatcaaacgatcttgaatacgtttgacaaaagcaaagaaatcttcatcagaaaaagcattatctaaggatagcattggaatatcatgtttaacttgagcaaaattacttaacggtttcgcccctactctctgtgttggcgaattttcactggcatattcaggatattgttgttccaacgcttttaattgatgaaataagcgatcgtattcactatccggaatttgcggattgtctaacacatgatactgatattcatgatggcgtaatagttgtcgtaattcttcaatttgttgcttgatcataaaaattccttgcttcaagaccgcactttaaatagtggctcattatacacaatcatactattttacgtaaaaaattgcccctgaaaatccagaggcaataaatcaatagaaaagtgcggtctatttttacaaaataatactaccgatcaacgccagagcaaaaccgactaaaccgattaatgtttccatcacagtccaagtttttaacgtggttttggtatccatttccaagaaacgacttaccaaccaaaagccactatcatttacatgagaaagtacggttgcacctgaagcgatagcaatcacgataaaacataaatcaaattgacttaagcctgtggctgatgacaccattggtgcgatgagagcagaagttgtggtcagagcaacagttgcagaaccttgagctatacgaagtgcggtagaaattaagaatgccgcaacgataattggcatacccgtatccgaaaacatttttgctaatacatcaccgataccgcttgcacgtaatacaccgccgaacataccgcctgcaccggttaccaatacgattgcacaaatcggacctaaggcgttatcgcagattttttcgatttgttcaaaactgcgttgttctttgagtaaaatgatagtcattaataggctaattaataaggcaataggtgttttgccgattaagcgtaaactttgtacccataatgtagaaccatcaattacttttgctactgctaaagtgtttaggaccgtgtctaacataattaaacaaagcggcaacagcaaaataaataatacttttttgaaacttgggggattttgaaccgcagtttcgttaattggagctgcatttaagaaagttttcggtagcggtaaatcgaattttttacctaagtaaagcccatataaataagtagcaaaataccaagtcggtacagctaaaatgaagccgacaatggtgagcaaaccgatatttgcacctaaaatatcaccggaagcgaccggaccgggatgcggaggaagaaatgcgtgggtgacagcaaatgcaccggcagcagggaacgcatagcggaataatgaaccaccgaattgttttgcaacactgaaaataatcggcaacattaccactaaacctgcatcaaagaaaatggggaacccgaataggaatgaggcgacacctaaagcgaaaggtgcttttttctcgccgaatttattgattaaggtatcggcaagtacttttgcaccaccggtaatttccaataatcgaccgatcattgcacctaagccgactaataaagctactgaggcaagggtattaccgaaaccacctaataaggtcggcaggattttatctactgacataccggtagcaagtgcggttaataaactcactaaaactaaggcaacaaaagcatgaaccttaaatttaataatgagaagaagaagtaatgctatggaagcaatcaaaataaagatcaacataaaatttccctattaataaaattaaacagcagcaagcataccaccatcaacgaataacaaatgcccattaacaaaatcagatgctttagatgaaagaaaaacagtcgcaccgattagttcttcaggatttccccaacgggctgctggagtacgtttgcacaaccagtcggaaaattctttgttttctactaacggacgggttaattcagttttgaaataaccgggagcaataccattgacttgaatattatgacgagccaattctacgcacattcctcttgttagcattttcaccgcacctttagatgccgcataaggtgtaatagtgtctcgccctaattcactttgcattgaaccaatattgatgatttttcctgcttgccgtttcaccatatagcgagccactgtttgggaaacaataaatacagatttttggttgacattaatgacatcatcataatctttttccggaaaatcgcagaatgggtggcgacgttgaataccggcattattaattaatacatcaattgctccaatatgttgttcgatatgagcaatggcctgatgaacggcttgagtatttgtcacatcaaaagcaacagcgtgagccttatggtctttagcagttaattcatcagcaaccaattgacatttttcttgattagtaccatttataataacttcagcaccttgttcagcaacaccctctgccaataaacgaccgatgccacgagcagatcctgtaattaaaattcgtttattttgtaaagaaaataaatcacacatcttcttatccttatgcaaagttaagttggatttttgaaatttcatttttattgccagcacgttgaagagcggtttctaattgttcaaatggataaatttcagaaagtaagggaagcggattgattttacctaaacttaaccacttcacggcggtattaaattcctctacaaaacggaaagaacctttccagttaatttcttttgaaatgagaggcatcatattaaattgtggaattgagcctcccatcccaatttgtacgatagtacctttcgcttttgtgacagctaaacaacgttcaatggaggaaatatgacctgaagcctcaaatgaaacatcaaattcgcctttgttttgtaaatattcggaaaaatttccttcagtggcatgtaatacttttgtagcacccatttctaatgctaaatctaaacaacgctgactaatatctgaacagatgatttctgctgcacccaatgcttttactgccgcaacagctaaacaaccgataggaccgacaccggaaataaacacttttttcccctgcaaatcaccgccttgttttgctgcgtgaatagttactgctaaaggctcagcaaataccataacctcatcggaaacttcttgcgaataaggaatacattggttgttatctacaattttatattgagtaaaaccaccatcaacgtgcggattgtacattgcactaccaaaaaaacgcattgtttcacattgattgctatagccacttaaacaatatgcacaacttaagcaaggtttgcttggattaattgcaaccttttgtccttcaaataaattgggagcgttggtctttacaattttaccaattatttcatgacctaaaatcatggggtgtttgattgcaaaattacccactttgccatgttcgtaataatgtaaatctgaaccgcagatactgccacgagtaatttgaattaaggtttgatcttggctttgttcatcaaattcaatttcttgagaaatgacatcaacagattttgctcctttaactacgcaagataacgtgtttattttcataaaatatcctccaatatttctgttactggtaacatatttatttttctagattgggtaaagtttgtgtgtttgattttgtgatttacgtcacattttttctttatttttaatgattttttaaaaaagtgcggttataaaaataaaaatttaaaacaataaatatagatttaagtgttattggtaactttttaaaattttttcaggtacactaagctcaatagcgtatttattagaggaacaaaaaatgtcaaaaggaaaaagtattattttaatgggggtatctggtacaggtaaaacatcagtaggaactgaagtagcgtaccgcctaggattgaaattaattgatggggatgatttacacccaagagccaacattatcaaaatgagacagggacaaccgctcaatgatgaagatcgtatgccttggttggagcgtattcgtgatgcggcatttagtttggagcaaaaaagtgaaaagggcattattatttgttcagcactgaaaaaacaatatcgagatcaaattcgtgatggaaaccgaaacattaaatttatttatctatccggcagttttgaattagtgctttctcgtctgcaaaaacggcaagggcattatatgaaaactgaaatgttgcgaagtcagtttgctacgttggaagttccccaagctgatgaaactgatatttatcacattgatattgacgcaacttttgaggaagtagtgcagcgttgtgttgaagctatcaagcctcttttagattgatgacaagaaatgcttgggcgtagaggcgttatctaagacgtagattacagacaatatttttgccataaaagatagtttttgagctaatgctacgaaaaaatactcaaaccccaccgcactttgcaagtacagtggggttataaatagaaaaagcgtagtcgatttttaccagtatgcattgttattcctatgttttgttttaaaaataaaattctgcgtggtgtattattgacaaggcgttgcacaaaacaattccagcgaaattcccacctttgcagtaaaaatttaattctcttggtgttattcttgtacgatctattctctctatatttgcatttttcctaaagcaaaactcgatctatctcacaaaaatattaacaaataatttacaattcaaaccgagcatgctaaaaagcaatcgtttgcaataaaaatattgcatacattgcatacaatacaacatcaatgacatcacacaggagcaactctatgaaaaaaatgaaagtcgtattgaccagtgcaacagttctacttgctacattgcttgccgcttgtggtgataataacaaagcgtcgaaagatgttactgcgagcaacgttgcggcaaacagcagcagtgctgaaagtgcggtaccagccacagtgcaaagcaaatttgtgaccattgctactggcggtgcttccggtccttacaatattattgcgacgacactgacaggtatttatagtaaaaatctaaaaactaattccaaaacacaaactaccggtgcatcggtagaaaatttaaacttgatggcacagaaaaaagtggaaatggcgtttgtgatgagtgatgcgttaaatgatgcgttaaatggtaccggcagtttcaaaaataaaattgagaatgtggaacaaatagcagcactttatcctaactatgtacaaattgtcacctctaaacgttccggcattaaaaccattaccgatttaaaagggaaacgggtagcgaccggcgatcaaaattccggagtcgaagtcaatgcacgtaacttacttgccggttttggcatttcctatgcggatattaaggttgattatctcggttatgctgcagcggcagatgctctaaaagcgggaaccattgatgcggcgttcttaaccagtggcttgccaaattctgctttaatggaattgcaacaaagttttgatctgcaattggtctctatcccggctgacggaattaaaaaattagctgcagataaaccgtattttaatgcgatggatattccagcgaacacctatggcaatcctgaaccgattccgacagcggcaattaaaaatgccttggtgatccgtaaagagctcagcgaagcagatgggtatttattaaccaaaaccttctttgaaagtttgccacaattgcaaaccgcacaccaagcggcgaaaggcattaacgtgaaagaagcacaggaaggtgcagttgcaccattacatccgggtgcaaaaaaatattatgacgaagttaatgcgaaataattcgttattaagttggtaagcatgaagataatgcctcgtaacggttggtttgtgctggtgccactcgctgttattgggctttatcctgttcattttatatcagttaccacaaaacaaggcgaatgcatcattggtgatgatcattttgcactacgttggcgtcactccgtcgagcatcaattgtggtatgaacattatcaacgacaaggtgataacctccacctttatcaaacatggttacaaacatttggtgctggaacaccttctcaaggtgaagttgtcacccatgtgccagtgggctatgtcggttttaaacaagatgttgttttacccgaaataaattggattgtttcgcatcgtatggaagggactattttgcttgatgataaacaatttcccgtttatcaaacacttcctaattattctgcggtaacaatcaaaccggctaaatctgtaattgcaacgttgtggttaaggaaatcatgttatgactgattctgtaaaaattgacaccacacttggtgccaaagaacaagagattttggaaaaatatgaccgtgaatcggtcactcgtcaatccagtagccaatttaataaagggttaattacgctggtttcggttttatattccctttttcatttatacaccaccttttaccccctaccgacgttaatccagcgtgcagtacacgtgggcgttggagcgatattaatcctattaatttatccggcatcgaaaaaacgtcgccaaggttctgttgcatggtatgactggttatgggttattgccggtacgagcggtatgctgtatctcatcaaccaatacaatgacattatgaccgtccgaggtggtattccaaatagcacagatattgtgatggcaatcatcactgtactagtggtgcttgaggtaacgcgtcgcgttaccggttggattttggtgattttttccttgctcttcttaatctatccattcatcagctcaatggattttatgccggacagcctcctcactcgcccttatgatgttggtgatatttttggtcagctttatttaaaaaccgaggggttatattcctctgctgtgggggcttccgtttcctttattttcttatttattttatttggggctttcctaagtaaatcgggaatggggcaattatttaatgatttagccttagcgatcgctggtgataaacaagggggagcggcgaaagtagcggtaatttccagtggctttatgggcagtattaacggggcagcggttgccaacgtggtgagtactggagcgtttactattccattaatgaaaaaaatcggttatcacaaaaactttgccggtgcggtagaagccagtgcatccgttggtgggcaaattctcccgccgatcatgggagcaagtgcattcattatggcggaaacgacaggcgtaagctacggaactattgcacttgcagccttacttcctgccttactttactatctcggcgtcattgcacaagtccactttcgtgctggtaaacaaaacctaaaaggcgtccctaaagatcaattgccaagggtaaaagcagtgatgaaagcacgtggtcatatgctattgccgatcttagcccttatcatctttttggcacaatccgtaccagtaggatatgctgcctcttatactattgtgcttaccattttagtcagtcaattgcgtcaagaaacccgtatgggcattaaagatgtaattgaggcattggctgacggggcaaaacagtcactttccgttatgtcagcttgtgcgacggtaggaattgtgattggcgtgatgaaccttaccagttttggtacggtgattacctcttctatcgtcacattaggtgcaggatcgctctttttaaccttatttttaacgatgattgcctccatgatccttggcatgggactaccttctattccagcatatatcattaccgccaccatggcagctccggcattggcaacctttgatgtcccggtattagtggcacatatgttcgtcttttattttggtattttcgctaatattacaccaccggtcgctcttgctgcttttgcaggtgcgggaattgcacaaggtgacccaatgaaaaccggctggcaatccttgcgtctagccctagcgggttttattgtaccgttcatattcgtttataatccgaatatgctgatgattgatgttaccaatgctgcggttattgccaaaactttccctctaccaagtgcattcgaaattattaatgttatcgtatcctctgttattggcgttttgggattatctgctgcggtagaggggtatctgaaaaatactataccaatatggcaacgtattattttagcaatcggttcgcttatgttgattattccggaatggatcacggatattatcggcattgctgttgttgtagtcatagcactacttaatgttcgccaatgtgactaacaattgttctgtgcatacgataaatgacataactaaatgtctaattaacttttttagatttgaaccaatcattaccccttgattttgcatagcttcacaaccggttgtggcggtttgggtgttagaatgtaatgaaaaaggttatttcccttaacacccaaaatactcaaaccccaccgcactttgcaagtacagtggggttttttgttgtgtttcagcaagtttgacaaattaccactgataacctatcgacacggcaccggatactttgccttgggaattgctattaccttgcagtttcagcataaccttaccgttatcgctgatgcgagaataaccaatcgccaacgcactttcgccatcatgtcctgccgccgcaatcgcaaccatggacttgcccggcatagagactgatgccaatgctgctgccgcattcgctccggcaataccggcacgcaatcggcgatcggcatgatgtatttgtgtacgtaacgcattattttgactgtccacatagtttttattgactgcaacaaatccacttgcatcaggtttgacatccggaattaaaatttccccacggttaccattgatgacgatattaccgttattgcctgataccatcaaccctgcatgggttgccatcaatgacggttcaccggctttgccttgtagctgaatgccatcgagggtgtaacttgctgattgaccggcatgatttcctttgcccgcaatacgggtaccttgtgccgttacwaccgyttcgctgtctggactgctcgctttcaaaccgttgctgtttagcgtagattttctaccgttcacttcacgagtttcaaacgaagtcatgttcttcaaccggtcagacaatttcacttctaagccattgccatctgtttccactttgatattgccggcggcggtgctgtcgctgttaaatgtatcaccttcgcctgtgatggatagtgtttcgctgagttgtttacgcacttcaacaccatcattgcccttgaacttcatgcccgatttcgctaccgcttgcacgtcagcaatggtggctacgttggttaaatccgcttggctatcaggtttcactaagtcagcaactttttcataacccttgtagttggcttcatagtcagcattggcttttgttaattctgtctgagctttggttaaagcagtttttgctttccctagctcttctttagctttttcaagctgtttcttgttttcctccaattgagtttgaagtttctttttatcctcaccctcaggcatggcactcatcgccatttctaaaccgctcacggctaaagttaaatcggttactttttgggctgtagttgaaagttctttcgcttgatcgcctattgctttcactttttcctcaacagctttggtgagtgcagtcgctttctcttgagcctcttttgctttarcmggatcagtttcaggrkcwgsyagtccyaaaccrctcgccacgttattcatcccgacaggtgcggtagtcggctcggcacgaataatcaccttgtccgattctgctgtaacttcttgtccatctttagaggtgtatttcttgctgtccacatcatacttcgccccttctaaatctttaggatcatagaacttaccatctcgtcctttaataactttggtatagctgtttccttcttttatatagaagtcaaacggacgattgctgtccaaatctgacactttttcatccacatagtttttattcgccgcacttgaaccgtcagccgtggcatctaggtctttcaagcccgtgattacgccagtgcccgatttaccgtcagtgcctttagcaaacgccagcgtagctcccttgccatcttgaccgtcctcaccgtcagccactttcaagctcacgacatctttaccagccttgtccttaatagcaacctcgccggctttcacctcggtggtgtgcttgccattgcttaaaacattcgcttctgctgtttgatcattgaccagaacctgatcatcgctgaccacagacattgtcacgccctcagccgttgtcacaaccgctttttccttatcgggatctgtattatccgtgatgatttgcgatgtcgccgtttgtgtatgagcgttacctgcctgatctttcaasacratttcattgccggtaatgttagycgtgttaccgytwtcgccgttaaactcggcagatttcaagcctgtcaagtcctcagtcgtaccaatcgtcaccaccgcagtggtgttcgatgttgtgcttggtgtactgcttgctgttccggctgtcgtcgtacttggagtagctcctgacgaagctgtactgcttgtaccatttccgccatttgtacctgcaccatttgacgaagttgtgcttgaagcgaccgcactatctgcccctacactgctatttgatacagtgtttgtcggtgcggttgtcggagttgtactgcttccgacagttgcacctgtaccttgtgcagccatatttgacgagccggacgtaccagctgaagtcgcaccatttccacctccaacggtacctgcaccacttgcgagtgcagaaccaaccgcacttggttgtgtagtaccattttgagctaactctactttaatattcaaaccggcattaaacttcaacgtatcgccacgaccgatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattaccatatgtttgcggtgcagacaaagtcactttgctaaatgtcggtgcgtctttaaagccgatttcgattttggcattgcccttatcgttggtgtattgcgtgattaagttgctaccgctgtaaccatcggttgatgttggagctaccgcacctgtccctgtcggcgtacctaaacgaacaatgttaatagttgagccgaggtagtgggtgyygttatttgtacccgttggaatatcaccgccgaatttcaagccctcgtttaacttcgctcttgcwtygtcaatagcayctttcaatgtrgttgggttcttctctttgaatgagccgtccacmttrgacagatattcaaagattrgakcaktaaatttcgttttatccttatyaacaccaayaccyaayttaccsgctaaatcagmmagttgtttacctgtaacagcttcttttgaactctcagcaatttcaccctctgaaatctcttttaattttgcrtcattaaaattaatttctttcttagttttgtctaaagtgattttcgcacctttgtcatctgtaccaccgctaatrctmtytayatctttaagattattcgccarrttatgttgaattgaaccattykyakctacwrykacttctatgttgtcatttttacctttmttraaatcyaagccktccgttagtttkacggtttgcttatttgtgctattmgmtttatakgtyawttttaattcatcaacatagtttttattcaccgcatcrtatttatcagttggatctgctacgaaaactatttttcttctgtttactgcattccctaccgatacagcattggatacgcctattgatctgtctcctaatactatcgcattttttatagtatcatctgtttctatgtgagaacctaataatatgttttcatttccatctactttgttgcccagtcctatagaaatatttttatatccttttatctcattatttgaacctattacatagcttgatgttgaatttaaacctattttattttcatcacctaayacaaamgagaarttacctttracatcattttctttacctacagcgacagaacttgttccyaatacrgttgaaccctgaccgatagagattgcaccgctattagaygcytcmgarttatarccyawggcaatrgaaccctcatttcttgacacggcattatgaccgatagaaatagarccytcgcctatcgcttgtgtttttgcggaatcagaaagtttaacggatttytccccwgtgccttttaggtagtcgactarggctttggcttgtactaattcgcttgtgccttctgtttcmtcttyytcaagakyratttymkcaataccgacrttttcwccaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttttatccctattaatatatttttactcgttttttcatactgtgttctaatattatcacttgaaaatttatctgttttatttatttttttatcttcaactgttatattcccagcttttattatcaagctatctcctaaatagtgtgttcctttttcttcagcactatctccagcaccaaatacaaaccctttatttattttatctatatttgcgttaatagcttgtctaaacgtttttgctgttgctggtgttgaagcattaatagttcctcctattaattgtttaaattttgattsyttaaatcctttagttgyatctacttctgctcctaatacagttgctcctaaatkkccaaatacatctattacactatataactgacttccattwatkgcatctgttgaagtagcacttatygttcctggwgctacatgtttaataagacgttcttttccastatctcctatacttaaaactgwtttatywgttccatgtccactaaamcyagtaaatttaatattacttgtatctgttgtatatgttgagacagtattttctttagtagtcgcttttgacccttgccctaaggcaatggagttgccggcggcggtttttactgttgcaccttgcccaatcgctactgcaccgacggcacttgcttcggctttagcactatgaccaataatcaccgcactttttgcacccgtttcagcttttgattttgccccaataagcacactttcttttgcagtttcagctgtcgctccattaccaatcagaattaaatctgtattcgcattctttgttcctttagacatttcatctgtcgtatctaatgcttgaatattgttccctaacgccacaatatccgtaccgtttttgattttatttttattaccgatagacgctgtccaagcggcgttttctatttttgttccatcttctccgtttttacctttcgcaaaaaccgcacctattgctatagaactyttggaytctwytaattytgttccrctacckatyacaacgacmgcacywyttayntnnttaaagttttgcgtaactntattattggamccyaanacaaatgagttngctacatctatacttacatctttacctatcacaaccgcattttgagctgtggctttcgtacccacaccaatagctattgcaccttctttcgttgctccatcattgttataattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacattaaaactcgtcgcaacatttttgaatttgtcatcaacgtattttttattaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccatcactaaatttatacccttgatttatagccttgattgtttcgtccaatgcgtctttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacacaccgcacttcggctgacgccccgacgctccctcaacacggctcgccacctgacggttattcgctaattcagacacaactttcgtttgaccggttgttacatcgtatttggttttgaagattttgttcatattctttactcgctttaaaaattatctgttaattacttattaaatggttattgnnnnnnnnnnnnnnnnnnnnnnnnnnnnnnnnnnnnnnnnnnnnnnnnnnnnnnnnnnnnnnnnnnnnnnnnnntaaataataggcgatgccttgctttttaagacacaacaaaaaaaggcgaataatactttcgccgaaaggttgaggttgaaataggtgatttttaagatgttgtttgaacatgtccaacctctcaaaattaacttgaaaggttgattttaggcaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtcattttttccgttctatttttttgttaagtaaaagtaaaatttgtcgtattttatcttgtatttatttgtaagaaaagcgtaaattaattattttaatgtcggggcggattatatccgctctttaatgttttgtttaatgtgtttggttttctgttcgggttttgacttgcacctcaaataaaattcggagaaaatatcggcttttagtcagtataacaaacgatcatgtcatattctcaacaagtaaataaacgtcgcacttttgcgattgtttctcaccccgatgcggggaaaacaacgattacggaaaaagttttactctatggaaacgctattcagaaagccggttcggtaaaaggcaaaggttctcaggcacatgctaaatccgactggatggaaatggaaaaacagcggggaatttctattactacgtcggtgatgcaatttccttatcatgactgcttggtcaacttgcttgatacaccggggcatgaggatttttcggaagatacttaccgcactttaactgcagttgacagttgcttgatggtgattgacagtgcaaaaggggttgaagaacgtacgattaaattaatggaagtcacccgtttgcgggacacgccgattttaacgtttatgaataagttggatcgtgatattcgagatccgatggaattgcttgatgaagtggaaagtgtgctgaaaatccgttgtgcccctattacttggcctattggttgcggtaaattgttcaaaggtgtttatcatttgtataaagacgaaacttatttatatcaaagcggtcaaggacatactattcaggatgtgcgtattattaaagggttaaataatgccgacttggatagggcagtgggcgaagatcttgctcggcaattacgtgatgaattggaattggtcaagggggcgtcgaatgaatttgatcacgatttatttattcgtggggaattaacgcctgtttttttcgggacggctttaggcaatttcggtgtggatcattttcttgatggcttgacacaatgggcacccgctccgcaagctcgtcaggcggattgtcgtttagtcgagagtgcggaagaaaaattaacagggtttgtgtttaaaattcaagctaatatggatccgaaacatcgtgatcgggtcgcttttatgcgaattgtttcgggtaaatatgaaaaaggtatgaaactgaaacaggtgcgtttggggaaagaggttgtgctttccgatgcactgacttttatggcgggtgatcgttctcatgcggaagaagcctatgccggcgatattatcggcttacataatcatggcactattcaaattggtgatacctttacgcaaggtgaagatctgaaatttaccggtatccctaattttgcaccagagttatttcgccgtattcgtttgaaagatccgttgaaacagaaacagctgctcaaaggcttggtgcaactttcagaagaaggtgcggttcaggttttccgtccgttaaccaataatgatttaattgtgggggcggttggtgtactccagtttgatgttgtcgtttctcgtttaaaatctgagtataacgttgaggcggtttatgaaaccgttaatgtggcaacagctcgctgggtagaatgttcagaggcgaaaaaacttgaagagtttaaacgtaaaaatgaacagaatttagcgttagacgggggagatagtcttacttatattgctccaacgatggtaaatcttaatcttactcaggaacgttatcccgatattcagttttttaaaacaagggaacattagtctttgatatgatagacaaaagagcggagatatttccgctcttttttgttgtttaaatagggaaagttgctcggtttaaatgcggtttaaagcgttttgcctattttcaactcgcattaatactcttgaacttcttcgtgtttttctaccgcacttttgatggttaattgcacttcagtagaaataattctatcgagaatatcgctaatgtcatttaatttctccgttatagcgacgccatttttatcaaaatatccgttggatcttaagctaccgataaaagcggaaaagacggctttatcgaaaaattccggtgcattaatgccatgcaatacagataaccgctgtgcaatagattggctttctttctctaaggtcgctttggcaatattcggggtatcttgcaagatactgacggtaatataataacgttgtaaaatttctcgaactcccgccatccataactgtaaaactcttacacgttctttattgattgaaagaagattttctgcacacagaattaatttttgacgtgtaaattcctcaataattttttgaacatattcatctaattcatcttgtgaaaagtgtaaaaataattcctcttttaagaaagggtaaatttttcgagctgcatttgataccaactctttttgtattgcaccatgatgaaaaatgatgcttgcaattaaagaaggtaaaacaaaaacatgttggatattattacgataataggtcatcaatactgctgctgaacgttctaaacgcaacatttcaccaaaattatctttttctacgataagtccgactcgttctaagtttaatacatgagtgagtatttcttccggtgtatcagtcggtacaataatatcgttggaataaggggcgtgttgtaaaaagcgttgataacttttcagttgttccaacagttgttcacgagataaagcacgttggcgagaagacaaaagtgcggtacccgttaagttcattgcattaattgccgctgctttgttgatattgatcatgacttgatttgaaatggcattaactgcagggttaaaccattgagaatgatcttccagctggctatctttccattcaggaaaatgttgatttaagtaattacttaatgtaataggttcggcaaaatttacataaccttgccctaaattgcgtaatttgcggataacacgcaagaccaaaccggcgttttctttctcttttgccgccccccgcaattcttttgcgtaagtatctacctctaatacatgctcatagcctacataaaccggcacaacggaaattggtctgatttggttttgttgtaaggcttgtacagtcatagacatcatgcctgttttcggggcaagtaaacgtccagttcttgagcgaccgccttcaataaagaattccacagagtagccacggtgaaataattctgctaaatattcacggaaaatggttgaatataatcgattccctttaaaggttcggcgaataaagaatgcacctcctcgacggaacatcattcccaccggccaaaaattgaggttaatacctgcggcaatatgtggaggcactaacccttgatgatatagcacataggacaataacaaataatcaatatgactgcgatgacaaggaatatatacaatttcatgtccttctaatgctaatttacgtacacgttccgcattttggacatcaattccttgatataatttattccataaccagcctaaaaaacgatctgcaacacgcaatccctcgtagttcacattggcggcaatctcatccaatatcttatatgcttctttacgtgctttttctttgctgattctcttacttttcgcttcatctgcgatggcattgagaattgccggtgattgtaataatttattaaacattgcttggcgattaggtaagcgaggacctgtagcggacattctttgtttggcaaaatggatttttgccactcgagcgagttttaaagcaatacttgcatctgttccatattcatcagccatatagcgtaaagaaaccgcttgtgaaaaacgcacaaaagtatcacgcccaaaccaaatagccacagctgttttttggatactatttaataaacgaagttttggtaagccaacctgcttttcatgacccggagaacgtccccaaagtacggaaacaggcactaactgtacatttaaatcaggtaaagagcggtgtaattcaaggtatttttcaactatctgaatagtcgctgacttagcacctttcgatttaaaaaaacgtctaccttcgtctaaaaatacataacgaggtaaacattgcccccccaattcattctcttctaagggatcaggcaatcctacgcttaagcaatttttacggataataattaaatctgtttgtgaagtgtaaggtaataaataaatgatcggttggctaatatctaatgataattcttcgataggttgttgcggtatagggttatttttaactaaaaaagagagagggacggacaaaagattacgataaaaattaagaatacttgacataacaatttccattaacttattaggttgattggctaatgaatactattctaacaaaaaaaatatttttttattaataaattaatttattgaaactaaagattgatgtaattttatttctgtatataatgtcatatattctgtatataaaaacaggggttagtatgagttcaataaaatcattaacgacacgacaacaggaagttttcgatctaataaaacgtcatatcgaaagtacaggaatgcctccaactcgagtggaaatatctaaagaattgggatttcgctctccaaatgcggctgaagaacatttaaaggccttggcccgtaaaggtgtaattgaaattgtatctggtgtatctcgtgggatcaggctattaacggatatagaagaaccggaaaatgaaggacttccgctgattgggcgagttgccgccggtgaaccaattttggcggaacaacatattgaagcaacttatcaagtcgatgctaatatgtttaaaccgcaagccgactttttattgaaggtttatgggcaatctatgaaagatattggtattttagatggtgatttgttggctgttcatagtacaaaagacattagaaatggacaaatcgttgttgctcgaattgaagatgaagtaacagtaaaacgctttgagcgtaaaggttcggttgtttatttacatgcggaaaatgaggaatttgagccaattgtagtagatctaactcagcaaccttactttgaaattgaaggtatcgccgttggcattattcgcaacaatgcttggatgtaaacatgacatcatgcagtaaatttgttatttaaaaatgagtagcggaacaaaaataagccaacaactatttgttggcttatttttaactatctagcataaatctcagcttcggcaaaaaaataggcaatttcacgttgtgcattctctaaactatccgagccatgaacggaattttgggtttgattaatagcaaattcataacgtaatgtaccattttctgctatttccggattagttgttcccataaaagtgcggtagtcttttaccgcattttctttttgtaacaccaaaacaactataggggcagatgtcatgtatctaatcaattcagcaaaaaacgccttatcgctatgttcagtataaaaaccttccgcctgttcttgatttaaatgcaacatcttcatagcaatgatttgaaatcctttgtcctctagacgagaaatgatgttacctattaaatttcgttcaactgcatcgggctttataatcgctaaagtttgttctaatgtcataggtctctccattattcagctttatttaataaaaaattcgccaaagtttgtacaccgattcccgttgcacctgttgcccataagtcacttgctgatttacgataagttgccgaacaatcaatatgtaaccaattttcttgataattttctacaaaataagataagaatgccattgccgtacttgcaccggcacccattggaacagtcccaatattggcaatatctgcaaaggatgaactaatttggtgacgatgtaattcgtcaaaaggcaatcgccaaaacggttcttttgtactctttgcacaatcgaaaaactgttgagtgagttcgttatccattgaaagtatcgcatgataatcattaccaaccgctacttttgctgcaccggttaaggttgcgcaatcaagaataaatttaggcttcgctaaatccgcatcaattaagccatcggcaagtaccaaacgcccttcggcatcagtattaagaatttccgcactgataccattgcggtagtgaataatatcacctaattttaaagcgttgtggctcaccatattttcagcacaacataaaaatagtttaactcgtttgttaagccctccggctattgccatacctaatgcacccgttaatagtgcggcaccgcccatatctgttcgcattgtactcatgctatcacttggtttaatgctgtaaccaccactgtcaaaagtaattcctttaccgactaaacaagccagtaccggtgcattttcatttccggtaggattaaaatccagctgtaacatagctggtaaattttctgagcctttacctacttgccaaatcccttgatagtttttttcagcaagttcttgtccggaaataatttgaaaagataccgcactttcgtcagcataaagacttgcttgttcggtgataaattgtgccgcacgctttgcaagttcaataggggtgataattgaagaggggagattaataatttcacgcacaaaatcgccacattgaattcttgccagcaattcagcttgtggctcgtcctctaaatgaggaaattcaatagtataatcttgtttagcggtataaaagccttgatagaatgcccaacaattttctaaatcccattctgatccaataagttcaacttcttttattccttggttgcgtaattttcgagcggctttttgaattaaagaaatgtcttggttacgtgtcggatgatgaatgatggcttgatcgtgagtaaaactgattaaagcttttttcccccattgttcttttgctggtgaaatttctatcttaatttgcatactttatccttaaatttacttgataaaaaaactgatatagatggcactataccagtttttcttgaggtaacaagaatgaatagggagaatgatcagaaataaagtctaattagcgtaaaaaagcaggaatgtttttttcatactctgcgattttatcttcatgttgcaaagtcaatcctatattgtccaatccatttaataagcaatgacgacgaaattcatctaattcaaaatgataaattttatttcccgttgtgacggttaaattttctaaatttacatgaatttcacaacctttatttttccatacccattgaaaaatttcttccacttcttcttcattcaaacgaatgggcaacatatgattattcaggctattattatagaaaatatcagcaaaactaggtgcgatcatgaccttaaatccataatccgccaacgcccaaggtgcatgttctctagatgacccgcaccctaaatttttgcgtgcaagtaaaatcgttgcaccttgatactcgggaaagttcagcacaaatttaggattaggtactgtaccttcctcatcaagataacgccattcgtggaataagtgttttccaaaacccactctggtaatagcttgtaaaaactgttttgggataatcgcatcagtatccacatttgcggcatcaagaggaaccactaaacctgaatgttgtttaataccagccataaatcttccttaatttaattccatataacgaatatcaacaaatttaccgaagacagccgctgccgctgccattgccggacttacaagatgggttcgtccgttacggccttgccgcccttcaaaattacgattactggtcgaagcacaacgctcccattcaccaagtcgatcatcattcatacccaaacacatagaacaaccgggattacgccattcagcaccagccgcaataaaaattttatctagcccttctttttctgcttgttctttaaccaatcctgagccgggaacaacaagtactcgttttacgttatctgcttttttgcgacctttcattactgtagctgccgcacgcaaatcttcaatgcgggaattggtgcaagatccgataaatacttgatcaacggaaatatcttttaaatcagtttccggagataagccaatataagctaaggctttttctgcggaggctttggtgacgggatcttgcatttctgctggattaggtactttctgatcaataccgataacctgacctggattggttccccatgttacttgtggagcaatgtcttttgcgtctaatatcaccacagtatcaaactctgcaccttcatcggtttttaaggttttccaatattctaccgcactttcccagtcttttccttttggtgcataaggacgatctttcaaataagcgaatgtggtttcatcaggtgcaatcagtccggctttcgctcccatttcaattgccatattgcaaactgtcattcgtccttccattgacaatgcacgaatagcttcaccacaaaattcaacaacatgaccggttccccctgccattgtggttttaccgataatggcaagaataatatctttggcagtaatgccttttgcgacttcgccacgtacttcaattttcatacttttggctctggcttgttttagtgtttgcgttgcaagaacatgttccacttccgatgtaccgataccaaaagctaatgcaccgaaagccccatgagttgccgtatgggaatcaccgcaaacaatcgtcatgcccggtaaggttaatccttgttccggccccatgacatgtacaattccttgctgtttactgttcatatcaaacaaagaaattcctgttgctttacaatttttatctagctctaaaacctgaattttcgcttgccctgttaatttgtttacgtcacgcacttgagtagaaatactatgatccattgtgccgaaagttttattcacttgacgaacctgacgacctgctacacgcaatccatcaaaggcttgcggtgacgttacttcatgaattaaatgacgattaatgtacaaaatcggcacttctcccggtgcttcatgtacaatatgagaatcaaataatttttggtagagtgtttttttcatatttattccgttaagtttttttcactaattaggtaagtgcggtagaaaacgagaaattttggctaaatttaccgcactttatttttcattctctattgcttaaattgcgtttacaattaagtctcccatttcagctgtggaaattggcggatgttcatctgctaaatctgcggttcgataaccttgagaaagaacctgtttcactgcgttttctattgaatccgccgcttcatttaagttaaagctataacgtagcatcatggcagcagatagaatttgagcgattgggttggcaatgcctttgcctgcaatatccggagcagaaccacctgccggttcgtaaagcccaaaaccatgttcatttagactggcagagggtagcatacccattgagccggtaatcattgccgcctcatcagaaataatatcgccaaaaatattagagcaaagtaagacatcgaaaaattcaggttgtttgatcaattgcattgtcgcattatcaatataaatatgatccaatgttacgtcaggatagttcttggcaacctcattgaccgtttcacgccataataccgagctgattaatacattggctttatcaacagatgttacatgtttacgccgtttcatcgctgtttcaaaagcaactttagctatacgttcaatttcatatttgtaataaacttctgtatcaaaggcacgagtttgcatttcctctccatctcgtcctttaggttgaccgaaataaatgccgccggttaattcacgaacagtcatcatatcaaatcctttggcagcaatatccgctcgcaatggacaaaatttttctaaaccttggtaaagtgtggcaggacgtaaattacaaaacaatttgaaatgtttacgcaatggtagtagtgcacctcgttcaggctgctgattagggggtaaatgttcccattttggtccgcctaccgagccgaataaaattgcatcactttcttcacagccatttaatgtagaagcgggtaaaggcgtaccatgattatcgatggctattcctcccacatcaaaagtgcggtaatttaatttgaaattatattttttttgcactgcatccaatacttttatagcttccgccataatttcaggaccgataccatccccacttaatactgcaatagtataacttttcatgatttttcctctttacatcaactttactgtgaaattttatgcgattttaaatctgccactttattggcacgataaatggcattgattgcatgaattaaggcacgagccgaagattctacaatatccgttgccaatccgacaccatgaaaacgtcgccctttatgttcgacaacaatatccacttgtcctaaggcttctgctccctcaccttttgcagtcaggttataatgcaacatagttatatccatatctgtaattgctaaaatagcgttataaacggcatcaacaggaccatttcccccatttgaaacttggctaatttttttaccgtccagttcaacttgcacaaaggcagaagccggtaaattactgattgtttgagaagtaataacatccaaacttagccgatcttcatcaccctgttgcatatcaataaatgccaatgcttccaaatcataatcaaatacttgcccttttttatcggctaattttaaaaatgcggcgtataatttatccaaatcataatcgttttgttgataacccattgcgtccatatggctttttactgctgcacgtcctgaacgagcggttaaattcaatttttcttttttcaatccgatggtttccggcgacataatttcgtaagtatttttatttttaaccataccgtcttgatgaatacctgaagaatgtgcaaaagcatttgatccgacaatagctttattcggctgaattggcatattacacaactggctaaccatctgactgacacgatgaatttcttgtgtattaattcgtgtatctaagcccttaaatatatcttgacgtgttttaattgccatgactacttcttccaatgcagtatttcctgcacgctccccaatgccattaatggtacattcaatttgtcttgcaccgttttgtactgaggtcaacgaatttgcagtcgccatgcctaaatcattatggcaatgcaccgaaattactgctttatcgatattcggtactctgttcatcacttgatcgatgatattaccgtattcggttggtaaacaaaaacctaccgtatccggaatattgactgttgttgcacccgctttaattgctgcctcaacgatgcgacaaatgttgtcaacacctgttcgaccggcatcttcgcaggaaaattccacatcatcggtataacgtctggcacgttttactgcttgtattgccatttccacgacatcatcaaaagtgcggcgtaatttagcttcgacatgcaaagcggaagtggcaataaacgtatgaatacggaacgcttcagctacttttaatgcgtcagccgcaatatcaatgtctttatccactgcacgggataaggcacaaacacgactgttttttatatgacgagcaatggtttgaacggattcaaaatcccctgctgatgatactggaaaccccacttccattacatcaacacctaaacgttccaacgccaatgcaatttgtaatttttcttttactgttaaactggcttttaatgcctgttcaccatcacgcaatgttgtatcaaaaataataatgttgttttgcataactctttccttcttattttgtatgttgccatctgcaaagtgcggtgcttttttattgattttagatacaaaaaaacccgcattctacttgtgcgggtcaactgacatgtttaactatacttctttgttccacaatttatccgcacaagaaatgtgatagtcgtaaattgagtaacagagaaagaatgtcaaacataaaatatcctaaaaataaaccaagatgggtttatattacgagtttaaaatgatgtgtcaaatgattttttagtgttttataccaaataaaaggttattcaaaacataagtttaatacataaaactaacttttaataatttaatagtgttaaaatccacatcgttaaaaaattttaattttttctaccgcactttagctctttcatagtaatgaaagtaaatttgtgtttttttgggggttctaaaaaataacttatcggcgttctttgagttgattttgttttaaatcaaataatcctatcatatacaactaaagagttatgcttttaacgtttcattttttacaccatgagtatagcttatgatagaatgcgtctccgaaaatgtttaaataacttcttatgcaaaataatcatctacaactggaacaacttgcctgtcagcgtggcgataagattttgtttactgacttaaatttagatgctaagtcgggagattttgtgcaaattgaaggacataatggcataggaaaaaccagtcttttacgaattattgtgggacttagtttccctgctaaaggtaaagtgcgatggaataagatcgaaattaataaaaatcgtgaagaataccagcacaatttactctatttggggcatcttgctggaattaagcctgaattaagtgcttgggaaaatttacagttctatcaaaaaattggtaattgtcgacaaagcgaggagttactttgggatattctacagaaagtggggttattaggtcgagaagatttaccggcaggtcaactttctgcaggacaacaaaaacgtattgcattagcaagattgtggttatcaaatgcggcattgtggattttagatgagccttttacagctattgataaacaaggtgtcaacgttttaactcagttgtttgaacaacatgtggaaaatggcggtattgtgattttaaccagtcatcaagagattccgagcaataagttgcaaaaagtgcggttagatcaatacaagttttttgatcaagggaatatggcatgatttttgtacaaattatcaaaagagagttaaaaattgcttgtcgaaagcaagctgagatcttaaatcctttatggttttttttgattattttaaccttgtttcctttggttattggtccggatcctaagctattagctaaaatagcccccggaatagcttgggttgccgctttgctatcggcattactttcatttgagcgtttatttcgtgatgattttgtggacggttctcttgagcaattgatgttgacagcacaacctttagcgatgaccgccttggcaaaagtcattgcacattggcttttaaccgggttaccgttaattttactttcgcccattgccggactattactttcattggagttgcatatttggtgggcattagttttaacattgttgttaggaacgccaaccttgagttgtttgggagccattggtgtggcacttacggtagggttgcgtaaggggggcgttttgctgagtttattagtcttacctctatttataccggtattaattttttctgccgctgttttagatgctgcaacattaaatttatcttataacgggcaactcgcaattctgggagctatttttgtttcagtggcaacactttcacctttcgccatttcaattgcgttaagagtgagcttagaccagtaattaacttagtgaagatttgttttttaaataacatagtaaggacaacatgatgtggaaatggttacatccttatgcaaaatcggaaacacaatatcacttatgtggtaagtttgttcctttgtttgcaacagtatctatacttttattaataaccggcgtaatttgggggcttgcttttgcaccggctgattatcagcaaggtaacagtttccgtattatttatattcatgttccggcggcaattttttctatgggaatttatgtgtctatggcaattgccggagtgattggtttagtttggcaaattcgccaagcgtatttgagtattctcgctatggcacccatcggtattgtgtttacttttttgacattggtcactggagcaatttggggtaaaccgacttggggaacttggtgggtgtgggatgctcgtttaacttcttccttgattttattctttttatatttaggcgttatcgcactttactcggcttttcaagatcgtttaatcggtatgaaagcagcagcaattctttctattgtgggggtagtcaatattccggttattcatttttctgttcagtggtggaataccttacatcaaggggcaagcattacaaaatttgaaaaaccttccattgcaacacctatgttaattccgcttattctctgtattttcggttttatggcattaacaatgtggtttactttaatgaattatcgaacccaactgttaaaagatgagagcaaacgcccttgggttaaagcattagtaaaataggagtttattatgttttttcaaagttggagtgattttttttatatgggcggtcatgggctttatgtctggctatcttatgggatttctttccttgctattataggattaggcttgcaaaatatttatcttcgcaaagccctatttaaagaaattcaatgtgaacaattgcgttcagtgcgtcaaaaaaatacgcaagctgaaaacaatggagaaaacctatgaacccaagacgtaaatcaagattatcggtagtactgtttattttcctgggcatatccgttgcctctgctttagtgttgtatgcgttgcgtcaaaatattgatttgttttatacgccaacagaagttgtgaatggaaaaaataacgaaagccataccaagcctagtattgggcaacgcattagaattggcggaatggttgtggaaggaacggtagaacgtgatcctaaaagtttaaaagtcagatttgacttaaatgatattggaccttcagtaacggttatttatgaaggtattttgcctgatttatttcgtgaaggacagggcattgttgctcaaggtgtacttattgagccaactgtactgaatgcaacggaagttttggcaaagcatgatgaaaattatgttccgccggaattagaagcacaaatgcagaaaattcataagcctatgggcatatcggatctcaagaatgaaagtgatcgtgatcgtcaagaaaaacaatttaaagaaggtaaccaatgatcgctgaattaggcaattatgctctggctttaagtttagctatttctgttttattatctatttttccattatggggggcggaaaaaggcaatgtgcagatgatggctttagctcgcccaatgacctatggtttatttgttagcttaactgtttcttttgttgcacttttctatttatttctgacaaatgatttttcagtacaatatgtggtgaacaattcaaataccaacttacctttgcaatatcgtctatccgctgtttggggctcccacgaaggttctttattactttggatttggctattgactctttggagtgcggctgtggcttttttgagtaaacaattaccccaagaagctgtggctcgtgtcttggcaattatgggtattattacgattggtttcttactatttgtgatgtttacttctaacccttttgaccgcactttccctgattttcctgttgagggaagagaattaaatccattattacaagatattggtctgatttttcatccgcctttactttacatgggctatgtgggtttttccgttgcttttgcttttgctattgcatcattgatgacgggaaaactggataccgcatgggcaagatggtcccgaccttggacaatggctgcttgggtatttctaacattggggattgtgctgggatcgtggtgggcatattacgaacttggctggggcggttggtggttctgggatcctgtagaaaacgcctctttaatgccttggcttgccggtactgcattgcttcattctcttgcggtaacggaaaaacgtggttcatttaaagcatggacagtattgctggcaattttggctttttcactgtgtttattaggtacttttttggttcgttccggtattttggtttcggtgcatgcttttgcctctgacccaactagaggtttatatattttagcttatttaattgtagttattggcggttcgctagcgttatacgcttataaaggcaatcttattcgcacaagaaacaatgctgaacgttattctcgagaaactatgttgttaatcaataatattttattaatgaccgcacttagtgtggtgttcttgggtactctcctgcctttagtacacaaacaattagggttgggaactatttctatcggctctccattttttgatcaaatgtttttattgatcatgattcctttatcacttttattgggtgtcggacctttagtaaagtggcgtcgagaccaattctgtgctattcgtcttccggttatcatcagttcaattattatgcttattaccggatttgttttaccttattttttacaagatcgtattgcagtgagtgccgttcttggtgtcatgatggcaatgtttattcttcttctagcactctatgaattgcagcaaagagcaacgcataagcatagcttttggattggcataacaaaattgtctcgttctcattggggaatggttttagcacatttaggggttgcgatgacgatatggggaattgcttttagccaaaattacagtattgaaagagacgttcgaatgaatgtgggggatacagtaaaaattgcagattatgaatttactttccaaggtatatccgatgtcaatggtgtcaattacttaggcggaaaggcacaaattgacatcagtcgaaacggtaagtttgaaaccacgttgtttgctgaaaaacgtttctatacagtgagtaaaatgacaatgactgaagcggctattgattgggggttatctcgagatctatatgttgcactgggcgaaagtttaaatgatggttcatgggctttacgcttgtattataaaccttttattcgttggatttggctgggaggtatatttatggcattcggcggattactctgtatatttgaccgacgttatcgttttggaaaacttctaaaacaaggataagttatgaataaaaaactttatataccattaattttattcctcggactagcctttgctttttttgtgcaactgcaacgtaatgcacaaagcgataatccaaaagcattggaaagtgccttaataggtaagtcggtgccaaataaactgctaactgatttactgacagataagcaatatgacaatcgtctattcaaacagggtaaacctttgctcgtcaacgtttgggcaacttggtgtccaacttgttatgcggaacatcaatttctcaatgaacttcataaacaaggtattaacattattggcattaattataaagataaaacggataaagccataaaatggatcaaaaagttaggtaacccttatcaagtaattgtaaaagatgaaaaaggatcttttgggctggatctcggtgtttatggtactccggaaacgtttatcgtggatggaaacgggattattcattaccgccataccggtgatataaatgaacgtatctggaaagaaaaaatacagccaatttatcaacaagtaagtgagaaaaaatgatgacaaaattacgttattttctgaccgcactttttctcagtttttcagcacaagctgcgattgatgcacttaattttacctctatgcaacaagaaaaagattatcacagcttgactcaagaactgcgttgtcctcaatgtcaaaataacaacattgctgattccaatgcttcgatcgctgtagatatgcgggcaaaagtgtatgaacttttacaaaaaggtcaaaataagcaacaaattatcgattatatggttgaacgatatggaagttttgtgacttataatccgccggtaacaggttcaacaatcattttatgggttgctcctttggctttgatgattcttggtgttgttattgtgctacgccgtaaatccggttcatccggtaaaagtgcggtagaagctcagccaaatttaactcaagaacaacaaaagcgtttagaagaattattaaaagaacgggaataaaaaatgattttttgggtaatttgccttttattaacattagctattgcatttatttgtttttatcctctgcttagaaacaagacagaacaatcaaccaatttaaaacgagatgaattaaataaggccttttatttcaataggttgaaagaaattgaggaagacgaacaatacggtttattagaaaatagtcaagagtttaaaacagaattacaacaaacgttgttggaagatattcctgaaaaaatggctgttgagaagagtaataagcaatacggacaaatttggtttatttccggttttttgactttagcgattattgctcctttaacttatatgagtgtaggttcttggcaatctgagataatgttagaaaaaacttacgaaaaattaccgcacttttatgcaagagtaaaagaggaagcaaacaaaccgctaaatgaaaatgagctacaacaatttgctgttgcactgcggttaaaattacaaaaagaccccaataatgcggctgattggtggacgctaggacaagtggcaatgaatctggaaaaagcacaacttgcttttgatagtttttctcaagccaataaattagcaccgcagaatattgaatataagctatcacttgctcgaattttgatgttttcacaagatcaaattgatcgtcaaagagggatgaatttattaaaagaagtgttgcgtattgatcatactaatatgcaagccttaagtttgcttgctttccagtattttgagtcggaagattatcaaagagccgctgtaacttggacaatgatgcttcggttcatgccgaaaaatgatccaagagttcctttaattgaaaaaagtattcgtacagcacgtgatgctatcaaagaagatagcaaataaaaccggttatatatgaaaaatttaaagtattttgcacaaaaatatgtggattgggttattcgcttgggaagaattagattttccctattaggtgtttgtgttttggcagtggttgctttgcttacacaaatagtggtgagtttaatttttatgggaactatctattggcaagatgtagctcgttctattatctttggtttgttttcagctccttttgttttatatttttttacgttattggtagagaaattggaaaaatcacgccttgatttagcgaagttagtggataatttacgcaatgaggtatcagagcgtattcttgctgaaagaaagttatcggttgcgttgagtgagattgaaaaaaccagtcaagataagaccgcacttatgacaacaatcagtcatgaattgcgtacccctttgaatggcattattggcttaagccagattttgcttgatgacaaattaacagagcaacaacgtaattatcttaaaacgattaacgtgagtgctatttctttgacgcatatttttagtgatattattgatctcgaaaaaattgatgctaatcgtatagaattacattatcaaccgactaatttgtgcagctttttaaatgatattaccaattttgctacattaatggcggcacagcgtaaattaaagtttgaattggtgtgcgataaagatttacctgattggctgatgttggatagcgcaagattaagccagatattatggaatttaattaataatgcagtgaaatttacacctgccggaaaaataaaactgaaggtttctcgcttgacggatgatactttttcttttgcgttatctgataccggtgttgggatagcaaaaggggagttggataaaatttttactatgtattatcaagtacaagaaaccgatcataaacctatcggtagtggtatcggtctggctgtgtctaaagcaatagcaggtttaatgggcggtgatttaaccgttgaaagccaattgcatcaaggggcaacctttacgctcactttacaggctaaagctgtagaaaaaccggcagaaagcgaatctaatgtgcctaatacattgacgatcctattagttgaagatattgaggtaaatattattgtagctaaatccgtattggagaaattaggttactgtgtggacgttgccatgaccggtaaagaggctattcaaaaatttgagcaaaattattatgatttggtgctgttggatattcaattgcctgatatgtcaggatttactattgcacaatatttacgtgaaaaatatgaacaaggtgtttatgattttctccctcctttaattgcattgactgctaatattatgcaaagtaaaaccgaatatcaaaaacaaggcatggatgatgttttacgtaaacctttatctttagaggcgttagtaaattgtttatcggattatttcggtgatgagttaaatacaaagattattaaaaaatcctctttcgtagagttttctgctttatccgatgttcttaatatggaactgttggttgagctgaatgatattttaggtaaagaatttattggtaaaaacctattattatttaagcaaactatgccaagctatgtaaatgaattattagatagttatgaacaatataaacaggatagtgcattaaaaaatgatttactttctaatgtgcataaaatcaagggagcagcggcatctgtcgggttacttcgtttacagcaagttgcctctttagctcaagatgctaaccacgaaaattgggaaacgcatatcgatgagtggatcaataccttggcaaatgattggttggttgatacggcgacattagaggattggttgaatgatctgtaatttattaaggaataatagttgcaaaaaggggagtacaactttaaacttgagcctttgccattgatatagttaacactcgaataattatgacaaatttaactgaaaaactggaagaaactgccagcaataatgagcttttattaggtgagcgttttcgcatggctcgtgaaaaattacagttgtctttagatgatgtatctaaacaaattaatttaagacccgctattttacagcttcttgaaaataatgagtttacacataagagcattcctacaactttcatgaagggttatgtgcgtaattatgcgaagtttctacgcataccggaagaaatatggacaaaagcaatttcctccgtggaggaaaatacacgccataatttaggtaaaaatacttgcttgatgaaagcggtaaatgggcattcttctcatgggcgttggattggttatgtaacggtattggtgttgttgattgtatccggtatgacggcgttatggtggtggggaaattaccaaaaatcaaatcaagaacgtgacacttttgtacaacattatgtagaaaatgcaccatcggagcggattgaaattcaagcggatcaagtgcttgaaaaaaatttaacgatccctgtggaaaagccacaggttgtttctgttaatgaaactactgttgtaaataaagacagtatggcagaaaataagttgacctcagtttctacgcaagagcaaagtgcggtacaaaatccacaagaaatagtgagcaacaaaacatcagaaactgaaaaaacggttaaaaatacagaaacctttgtcggcggtgatttgcaaatagaaattatcggggccagttgctggattagtgttaaagacgctaaacataaagtattagcacaaaaagaatataaacaaggcgaagttttggtctttactgatggatcaccttattctttgattatcggtgtcccaagcaatgttaaaattacttacaaaggtgaacattatccattaaaagttgacggacgtgttgctaaattcaaattacagtaaattattatgtcatcgtttaaaccaactattaatcgtcgtcaatcgacaaaaatttatgtgggaaatgtaccgataggtggtgatgcacctattgccgtacaatctatgaccaatacaagaacgactgacatagaagcaacagtggcacaaattaaagcattggagcgtgtcggtgctgatattgtgcgtatttctgtgcctactatggatgcggcagaggcgttcaaatcaattaaacagcaggttaatattccgttagttgcagacatccactttgattatcgtattgctcttaaggtggcggaatatggggtagattgtttgcgaattaatcccggtaatattgggcgtgaagatcgtattcgtgccgttgttgattgtgcgaaggacaaaaatatccctattcgtataggtgttaatgcaggatctttagaaaaagatctacaggaaaaatatggcgaacctacaccggaggctttgctggaaagtgcgttacgtcatgtggaaattttagatcgtttgaacttcgatcagtttaaggttagtgtgaaagcctcggatgtctttcttgcggtagaaagctatcgcttattggcaaaagcaattaaacaaccactgcatttaggaattaccgaagccggtggagcacgtgccggtgcggtaaaaagtgcggtcggtttggggatgcttttagcggaaggcattggcgatacattacgagtttctttagcagccgatcctgtcgaagaaatcaaagtcggttttgatattttaaaatctctacgtattcgttctcacggcattaattttattgcctgtccgacttgctctcgtcaggagtttgatgtgattggtaccgtcaatgcacttgagcaacgtttggaagatattgttacaccaatggacgtatccattatcggttgtgtggtgaacggaccaggcgaagcgttaatttcagatcttggggtaacaggcggtaataaaaagagcggttattatttagatggaaaacgtcaaaaagaacgctttgataatgaggatttaattaatcagttagaggcaaaaattcgtgcgaaagtcgcacagcaagatccaaaaaacagaattatctaaaggaagaatattgtggcaaaaacaattcaagcaattcgaggcatgaacgattgttcacctactgaaagtctcttgtggcagtgggtagaagaaaaagtgcggtcggttttacaaacttatggttattctgaagttcgaatgcctatcgtagaaagtacccctttatttgctcgtgctattggtgaagtaacagatgttgtatcaaaggaaatgtacacattttgggataacgatgaacaattaactttacgaccagaaggtactgccggatgcgtgcgtgcggcaattgagcatggctggatttacaataatgaacaacgtctttggtatatgggacctatgtttcgtcatgagcgtccgcaaaaaggacgttatcgtcaattccatcaagccggtgtagaagtgtttggtatagcgaatccggaaattgatgctgaattgattttattaactgctcgtttatggaaacaactgggtatttttgatcatgtaacgttacaacttaattctatcggttctcttgagtctcgacaaaattaccgttctgcattagtggaatttttacagcaacatacggatctattaagtgaggaagaaaaagaacgtttagtgaaaaatccactacgtattttagatacgaagaatcaggtgctacaagaagtattaaatgatgcaccgaaattattggattatttagatcaagagagtcgagaacattttagccaactatgcgatttattagattccgtcggtattcaatatgaaatcaatcctaaattggttcgaggtttagattactacaataaaacggtgtttgaatgggtaacttccgctttgggggcacagggtacagtttgtggcggcggtcgttatgacggtttagtcgaacaacttggcggtcatgcaacttgtagtgtgggttttgctatgggattggaacgcttggttttactggtgcaagaagtgaataagcaaatcgttttaccaagtgcggtagatatttatgtggtttattttggtgaaaaaacgactttacctgcattccagttagctgaaaaaattcgtatggaattaccgcatttacgcacaatgacacattgtggtggcggtaactttaagaaacaatttaaacgtgcggataaagttggtgcaaaatttgctctagtgattggcgaaaccgaggtgaaaacacggcaggttgtcgtaaaagatttactgggtggtgccgagcaattgagcttggcattaacagatgtagttatttacttaaaacaagcaattactcaataaggatactaaaatggcttatacaatcgaagaagaacaagaactgaatgaattaaagacttggtggaaagaaaattacaaatctattattgtaattgtggttcttgccttttcaggcgtatttggttggcgttattggcaagattaccaaacaacgaaaaaacaaacactttctgcacaatatgatgaactgatcagcagtgccgaaaatcaaagcatctacaatgctcagctggatcggtttgtgcaagaaaatggagaaacaacttatgctgtgtttgccttgttagataaagctaaacttgaagtcagtcaacaaaattttgtgcaagcagaggaaacattaaagcaggctattgtgaatacgagtgatgatattttaatgtcaattaccgcaattcggctagccacagttcaataccagttacaaaagtttgatgaggctttagcaagtcttaatcaagttaaaggtcaatcttgggatgttagcaagttgttattgtccggtgatatacagttggcaaaaggcaataaagagatagcaaaggacaattttgaacaagcactaacaaaagccacatcttgggaaaaatcattcatccaagtcagattaaatagtctgtaattgtctaattattgaagccttgatacctcaaggcttttttataggaagttatttatcatgaatattcaacacttattgaaaacacaagcctatattaatggagaatttatttctgccaaaaatcaccgcacttttcccgtgataaaccctgctaatcaacaggttatttgtgaaattgcctgttgtggtaaagaggaaacagaattagcgattaaaagtgccaaacaagcacaagtacattggaaaaaatatacagcaaaagagcggtcaaaaattttaaagaaatggtttgaattgatcatgcaacatcaagaaagtcttgcatatttattaagtttagaacaaggaaaaccgcttagtgaaagtcgagctgaaattgcttatggtgcaagtttcgtcgaatggtttgctgaggaagctaaacgtgcttatggtgagattatcccccaagtgcgggaagaaaatcgcttactggtgattaaacaaccggtaggggtagttgctgcaataacaccttggaattttccaaatgcaatgatcacacgaaaagccgctccggcactggctgcagggtgtgccattattattaaacctgcaccggaaacgcctttatccgctttagcattggcagcattagccgagcaagcgggtataccgaaaggtatatttaacgttttaccgacagtatatgcagaagaagtcggaagtgttttaactcgaagtactgatgtacgtaaattaacgtttaccggttcgactaaaattggcaaaattttaatgcagcaatgtgccgatacggtgaaaaaaataagtcttgaattagggggaaatgcaccatctttgatttttaatgatgcagatttagacagaaccgtcgattctgttatagcctcaaaattccgcaactcagggcaaacctgtatttgtactaatcgaatttatgtgcagtcggagatttatcgtgcgtttgctgataaattaaaacaaaaagtgcgatcatttatcgtaggcgattttcagcaagaggcggtaaatattggaccgttaattaatgaaagtgcggtacgaaaaattgaacgacacattgaggatgcgttaagcaaaggtgcaattttaactttaggtgggcaacgccattctctagggggaactttttttgaaccaactattttagaaaatgtgtcgcaagatatgttagtttgccatgaagaaactttttcccctctagcagctttgattcctttcgatacggaagaacaagcaattagcatggcaaatgatagcgagttcggtttagctgcgtatgtgtatacacaagatttcagtcgtatttggcgactttcggaagaattggaatgtggattagttggagttaatgaaggcattatttccaatgaagtctctccgtttggtggagttaagcaatcgggcttgggtagagaaggctctcgtcacggactggatgagtttttagaaatgaagtatttgtgtatgaaagtttagtttgcaatgcaacaagtcaattgattatccctgctgaggtggaaagtacgacaacacgtgtattaggatcggcaattataagttttgaaactgcgagattagacatcggtaaattccttttagttaaggaaaggggctattgccccttatgataattattgacgcacagtatagtcgcctgaacaaacccatttgtaggtggtaagcgcctccaatcccattgggcctcgagcgtgtaatttttgtgtactaaccgctacttctgcccctaaaccgaattgtccaccatcagtaaatcttgtgctagcattaacataaactgcggcagcatccacaagggaaacaaattggtgagcaagtcttggtgatgacgttaaaattgcttctgaatgttgtgtgccgtattcggtaatatgtgcaatggcttgttgaatatctttgacaataacaacatttaaatccaatgaaccccattcttgacgtagctgttgttcttgtacaatagatacttctgcattttgtttttccaatattgaaagcgcggtcggatctgcgtgatattttacatttttgtgtttcaaatgagcgacaagcttaggtaaaaattctgtggcgatactttcttgcactagcagagtttctaaggtgttacatgtactcggacgttgagttttagcattgtcgattacagccaaggctttatcttgctccgcactttcctccacaaatacatggcaaaccccaacaccgccaataatgaccgggattgtagagttttgtttgcaaaactcatgtaaacccgcaccgccacgaggaataatcatatccacatatttatccaatttaagtaattctaatacgaagtttcgatccggatcggtaatagcttgtaccgcatttttaggtaatccggtttgctccaacgcatcttgaattactgttaccaaaattttattggaataattggtttcttttcctcctcgtaagataacggcattacttgtttttaaacaaagtgttgcaacatcgacggttacatttggacgagcttcataaattacaccaataacacctaaaggcacacgaactcgttctaattttgtaccactttctaaaataccgccatcaatgatttgtccgataggatccgacaatgaaataatatgacgaacatcttttgcgatactatttatgcgttccttggtgagtaagaggcgatcgataattgcatcagataatccattttcttttgccagctgaatatccttagcattttctacaagaattttatcgctttgtaattccaattgttcagcgataatttgtaaggcggtatttttttgttgttgagaaagttgagccaaaatcgtagcggcttgtttagcattttttcccatttcttttaaactcatacaatatccttattttgtttttttaggtaatttatcatgcgttttgactttttctgcttcttgctcttgataatcaaaaataggcaatccccattcgaaataaatggcgagcaaacgaatagtgaagccactaattaacgtaataataatgaccaaattttgattaatctgtaattgttgtaagccaacataaataccggtagctaataatgcaacactggcataaagctctttttggaacactaaagggatgcggttacagagcgaatctcgtaatacaccaccaaaggctcccgtaacgatagcggctatacaggtaacagtaaaaccatgccccatgtccaaagcaatttgagcaccaataatggaaaatacgatcaatcctagtgcatctaagaccaaaaaaatggtacggaagtagcgtataaagtgtttgataaaaggagctataaaaacagcgagtatagccgctccggtaacaatcaagaaataatgtgggtttttaacccaacccaagggataatgcccgagcaagatatcccgaatcgatcctccaccgatggctgtcattgaagcaataataataaccccaaaaatatccattttttctcgtccggcagccaatgctccggttatcgcttctgctgtaatgccgataatatagagaatactcagtaacataagtgtccttaaagtgcggtaaaaggattactattttagagtgcatagaacaaagaaacaatgttatttttgagctaacccaagaagttaggcggatttattgcaaggaaaatttaaccggataaaaaagaaattctcatatcatcaaatttagcaaggattattcattagaagaataaagtatttctttataatgtttacggcataccgacatataactatcatttccgccaatttgaatttgctcaccgtctttgactgctttaccttgttcatttaagcgtaaaacaaaattagctttacgtccgcagtaacaaatagttttcaattcttcaagttgatctgcccaagccaacagatatttgcttccttcgaataattctgcttggaaatctgtacgcagaccatagcataataccggaatattgagttcatctaccacattgcttagttgatagacttgtgctttcgttaaaaactgagcttcatcaattaaaatacaatgtaatttttgttgcttaatatgcagtgctatttcagtaaaaagatcagtgtctttatgaaataaattcgcttgtctatgaatgccaatacgtgaactcactttacctttaccaaaacgatcgtcgatggcagctgtataaactaacgtattcatgttacgttcacgatagttataatccgattgtaataaggttgtagatttccccgcattcatcgtggaataataaaaatatagttttgccattatgttaatacccaaccgccggaaataatatatattaagtttgatttttccattatttatcttaaattgctttcagttcagtcattgcccagcggggtttaacgtcaatttccaaaggtgaatattcaccttgttttagacgcaaaaaaccgacgtaagcaatcattgcaccgttatctgtacaaaattgaggttgagggtaaaagacctctccttttaattgtttcatcatatccgctaaagattgacgtaattgtttatttgcactcacaccgcctgcaatgactaagcgtttaaagcctgtttcttttaaagctcgacgacatttaattgctaacgtatctactactgcttgttggaatgcgtaggcgatatctgctttagtttgttcagtgagttcaccttcttgtttaattgcttgattaattgtattggcggcaaaagtttttaaacctgaaaaactaaaatctaagccggggcgatctgtcataggacgaggaaagaaaaaacgttcgggattcccttgttctgccaaacgtgaaagtgcactccctccagggtaatccaatcctaataattttgccgttttatcaaatgcttcaccggcagcatcgtcaatactttctcccagtaattcatattgccctacagcattaacacgaacaagctgtgtatgtccgccggatactaataacgctacgaaaggaaattttgggggattattttctaacataggggcaagtaaatgcccttccatatgatgtacaccaatagctttaatgttccaagcataggcaagcgagcgtgcaattgttgaacctactaaaagtgcacccaccaatcccggtccacaagtgtaagctatgccatcaatgtcttttgcttctaatcccgcttgttgtaaagccgcctgaattaatggtgcggttttacggatatgatcacgagacgctaattcagggacaacaccgccataatcagcatgtaaagcaatttgagtatacagttgattggcaatcaatcctttttcttcatcgtaaatggcaacgcctgtttcatcacaagatgtttctatgcctagaatacgcattttgtttctcttctttattgaatttcgaaatagagtagattctaccttttttacttaaattaaactagcgtattgatttttttaagagaaaaagtgcggtatttaaaagtgcggtattttttagaatttttttattttttcgacatatctcgcaaaattagcttgcttattttctaaatgaatttttttgtattaacctcttaccagttatgagtacggaacaataggaaaaatatggataaccggaatgagctgttactgcgtttgttacaagtgccgaagttgggagcgtccggaataactcaacttttatcgcacatcgatttaaaaacattagaggattatgatgatgttgcgtttcattatttaggctggaaacctgaacagataaataggtggttgtatccggatcttagatatattgaacctgcattattttgggcaagcaaaaagggacattatttgatgaatttttatcaagagaattacccttatttattaaagcaaaccataggtgctccccctttgttatttatcaaaggcaatccggaaatacttgctcaacaacaagttgctattgtaggaagccgtcattgctcacattatggcgagtattgggcaaagtattttgcaacggaattgttccttgctggttttgttattaccagtggactggctttagggatagacggtttttgtcatcaggctgttgtggatattcaaggacaaactatcggggtattagggggaggtttggaagagttgtatcccaaacaacataaaaaattagcacaacaaatgctagattatggcggtgcgttagtgtcagaatttttacctcatcagcctcccaagccacaacattttcctcaacgtaatcgcattattagcggactttctaaaggtgttttagtggttgaggcaacagaaaaaagcggttcactcattactgcacgttatgctttagaacaaaatagagaagtttttgcacttccgggacaaattcaaaatgagtatagtcaagggtgtcatagattaataaaagacggtgcattgttagtagagaatgttgcagatattgtagaaaatttatcgccttttatgcattatgaacgtcaactaacagcaaaacagatagaaacgcaatttccgccggcttataagttacctgcttcaccgacttatcctgaactctatgcccatattggatatacgccggtagggcttgatgaattatcaaataaaagcggattaagtgtagataccttattgatacagctgttagaacttgaattgcaagatctcgttattgctgaaaaagggttatatcgacggacttaaatgttgatataagcgataactgacttgttttgtgtttttttcttttaataattgccaattcgcaggcgttgttaaggttttttctcgttctgtttccacataaataagtgcattggcatgtaaccaattatgctgtactagtaacttaatggcttgttcagcaagattaaagtagaaaggaggatcaataaaaacaatatcaaagtgcggttcggtttgagttttgtttaaatagtgcaaactattttgattaataacgtttgcattggtacattttaatatagcgacatttttattgagctgattagctattgttttgtctaattcaaggaatgtaacattttttgcttggcgtgaaagtgcttcaaagccgagagaaccgcttccggcaaagcagtctaaacaattggaatcaacgatatgaggcattagccaattgaataaggtttccttaacacgatctcctgttggtcttaaacctgtagaattcaaaacaggtaattttctggcacgccaaagtccggcaataattctgacttcccctttgtttttctcttgtatacggtttggttgattttttttcattaaaaattaattatgataaactaaatgcagtttcgtgattttaacagaaaagtgagcaattttatgtcagaagaaaagaaaaaaggtagattttggtcttggttaggattggggcagaaaacagaagattcgatatcagaacagcaaccggagcaacaatcaggacaacaggaaagtgttgcaagcgagcaagaatctacttcgaatatagagcaggttataaaagaaccagagcatattgatgacacttcatcagacttggttttatccgctcatttacaggagcaagaggtaaaagaatactcacttcatgaacgggaactgtctcaaaatactgtaatagaaatagaaagtgcggttgaaaaaacagatatttttattgaagaggatacaacatatcaggctatcaataaggagcagcgagaggaaacaacgattacatcggtaaaagaagtaataccgcaagaacaagaaaaaccggctgaaaatggtttttttagtcgtttagtcaaaggattattaaaaaccaagcaaaatatcggtatcggtttccgcagtttgtttttgggcaagaaaattgatgacgagttatttgaggagttagaagaacaactattgatcgctgatatcggtgtgccaactacgacaaaaatcatcaataatttaattcagcatgcaagccgtaaacaattgcaagaggcagatttactttatcaacaacttaaagtggaattagccgatattttaaaaccggtcgagcaacctttacaacttgataacagtaaaaaaccttatgttatcttgatggttggtgtaaatggtgtgggtaaaaccactacaatcggcaaattggctaatcaattccaaaggcaaggcaaatccgttatgttggcggcaggagatacgttccgtgctgcggctgttgagcagcttcaagtttggggagaacgtaaccagattcctgttattgcacaaagtacagggtcagattctgcttctgtcatttttgatgctatgcaatcggcagtggcacgtaatattgatgtgcttattgcggatacggctgggcgtttgcagaataaaaataacctgatggatgagttgaaaaaaattgttcgtgtgataaaaaaatgtgatgaaacagcaccgcatgaaatcatgctaactcttgatagtggaacgggacaaaatgcaattagtcaagcgaaattgttcaatgaagcggtaggattaacgggtattagtctaaccaagttggatggaacagcaaaaggcggtgttatttttgcgattgcagatcaatttaatttacctattcgctatattggtgtcggtgagaaaatcgatgatttacgcccattccaagcagatgaatttattgacgcactttttgtacaagaagagtaaatgttgaaatacaaatcttagaatgattatcttagatggcaagttattatttagcataaaacgtaggaaattctatactatcgttgactatgcctctaatgataggaagtgcggtattttttatatgaattcaatctagttttaaatcattttacttaacattacttagaaataagatgatcttttcggatgcccaacaatattaacatcacaaaataagttatcacagcgacgaaaatcagccagcccagccaatgtacacgagtgaaaaaggtcatttgtttccagagactgagtgctggtgaataataccaaataaccattcccataatgatcgcagagattaaaactttgacaaaaaagaccgcactttgtcgagtaaaatggtaaatatccgctttagctaatcctcgataaagcaagtaagcattcagtgttgctgacattgctgaagcgatagccaatccaatataactgaacgggatagcgagtaaattaaatcccatattacttaccatagcaataattccgatttttaccggagtttgggtatcttgccgagcataatagccattggctaaaattttaatcagcataaaactcaacaatccggtgttaaatgcccaaagggaataagaggcggcttgcacatcagaaaatgaaaatttcccacgcatgaacagtaccaataacatcggttgtgccaaaacagcaatgccaatcattgccggaatgccaaataataagatcattctgacgccccaatccattgtttgacgaaaatcaaccgcacttttttcaatgttatctgtacgattaacataatgtcgagatagagttggaagaataacggttgaaatcgcaataccaaataaaccgagaggaaattctaataagcgatctgagtaataaagccagctgattgatccagtcattaaaaaactggcaataaaagtatccaatagaagatttatttgatttacagaaacaccgaatagtgccggaatcatcaaggttcttattttttttacgccctcatcatgccaagcccattgaggttttgttaaaaatccagcttgttttaaaaaaggaatttgaaagagaaattgtagcaagccgccaataaagatcccgatagcaagagcaagatcgggactttctaatcgaggagcgagaaaaagagcggtgcaaatcatagctatattgagaagaacgggcgaaaaagacatcacgccaaatttaccgatggtatttaaaattgcaccagataacgccacaaaagtgataaaccataaataagggaaagtaattttgaggagtaaagaggcttgttcaaattttattgcattggagctgtcatttagccaatcaataaaccaacctgtgccaaagatcgccgtaattacaggagaaaaaagcattgctaataaggtcactactgaaaccaatccgcccaaagtacctgatactttacctataaattctctagttttacttaaatcgcctgatttttggtattctgctaaaactggtacaaaggcttgtgaaaaagcaccttcggcaaataaacgtcttaaaaaatttggaatgcgattagcaaataaaaaaacatccgccactacacctgcacctaatatttgtgcagtaataacatcacgaattaaacctaagatacgtgataacaaagtcattgcactgacgataatgcctgatttcaataattttttgctcaaaataagtttcctttcatgaaaaattggcttaattgtatataaattttgtttttaagctatattccaaacgaaaaaactgttaaaattccgcctacatcgtaactaggctcaacaactaaaggcaattgaggaaagctaacgatggttgtttcggttgtgtctcaccgaaatcctcaacccaaattttgctaattgtttattgacaattgtatagaaaaaaggcatattttacgcctttattttttcgtaaactaacagatattttaggagtttgaccttggctaatatcaagtcagctaaaaaacgtgcggttcaatctgaaaaacgccgtcaacataacgcaagccaacgctctatgatgcgtacttttatcaaaaaaacctatgcagcagtagcaacaggtgataaagcagtagctcaagctgcttttgttgaaatgcaaaaagttgtagaccgcatggcatctaaaggcttaattcacgctaacaaagcagctaaccacaaatctaagttagcggcacaaatcaaaaaattagcgtaattttttaaaaccgataaaaacaaaaccgcactttaaagtgcggttttttatcagctgttgattaacgggtactggtactcgttgtcgtacggtttgcacgtttacgctctacctcagttaaaagttttttacgaatacgtacagaaattggcgttacttcaactaactcatcatcatcaataaactctaatgcttgttcaagtgtgagtttcaatggtgtggttaaagtcaaagcatcatctttacctgaagcacgcatattggtgagttttttaccctccagcgggttgacagttaaatcattagagcgactatgaataccaattatttgtccttcataaatttctgcaccatgatcaaccattagcttgccacgatcttgtagggcataaagtgaataagccaaggctttacctgtaccgtttgaaatcagtacgccgttaatacgctggccaatttcacccagttttacatcatcataatggctgaaacttgagtaaagtaagcctgtccctgaagtcattgtcataaattcattacggaaaccaatgagaccacgacttggaataatgtattctaagcgagtacgacctttaccgtccggtatcatatcacgtacttcacctttgcgaataccgagtgcttccatgacagaaccttgatgttgttcttcaatatcaatagtcacttgctcgaaaggctcttgcttgcgaccatcaatttctttaaaaattactttaggacgagaaaccgccagctcatagccttcacgacgcatattttcaattaatacggataagtgcaattccccacggccggatacactgaaaatatccgaatcatccgtttcttctacacgcaatgccacattatgtacaagctcttttttcaaacgctctaaaatttggcgggaagtgacaaatttaccttcttttccacagaatggtgaagtatttacacaaaagaacatagttactgtcggttcatcaacgcttaatgcaggcaatgcttccacattgttaatatcacaaacagtatctgaaatatttaactcacctaaaccggtaatggctataatatcacctgcataagcttcttgagcttcgtaacgctgtaaacctaagtgtcctaaaacctgaccgatacgaccgttacgggttttcccttcaggatcaattaatgtaacaggttgatttggttttactgtaccacgtttaatgcgtccaatcccaatgacacctaaatatttgctgtaatctaattgggagatttgcatttggaacggtgcatccaactcaacatccggcggtgaaacatgttcaataattgcttcaaagagcggatccatattagaagccaatttttcatgttcaagaccggctacaccgtttaacgcagaagcataaataataggaaaatcaagttgttcatctgtggcacccaaatttacaaagagatcaaatacttgatctactacccagtcaggacgtgctccgggacgatccactttattgattacaacaatcggttttaaaccatgtgagaaggctttttgggtgacgaagcgggtttgtggcattggaccgtcaaaggcatcgacaaccaacaatacggaatctaccattgaaagtactcgctctacttctccaccgaagtctgcgtgtcctggtgtatccacgatattaatacgatagccgttccaattaattgcggtatttttcgcaagaatagtaattccacgttctttttccaagtcattggaatccattacacgttcatcagtatcaccacgagaagtgtctaatgtgcctgaaagtttaagaagcttgtcaacgagggttgttttaccatggtcaacgtgtgcaataattgcaatattgcgtaatttttgaatatcaattttatctgtcatttgaataatctagagttataaaaaattaaaaatttcttccgcactttacgtttcaaaatagttcatttttacatctataccgtgcggaaaggtcgccgattatacaactttttgttattaggagctataaaaaaacgacctccgacctttaccgatataaaattccctatcctattcccctctaattgattataatctccgttcaaatttatttccgttcccactaaagtagagagagtattatgtcaaacacaacagctattacgaatgtattcaagttaatcgaagaaaatgatattaagtttgttcttcttcgttttaccgacgttaagggtaaagaacatggcgtttccctgccggtcagtttagttgatgaggacttgtttgaagacggtaaaatgtttgatggctcctcagttgaaggttggaaagccataaataaggcagatatgttattgatgccaattgctgaaaccgccgttgttgatccttttgctcaaattccgacactttcaatccgttgcagtatttttgaaccgactactatgcaaagttatgacagagatccacgctcaattgccatgcgtgcagaaaattatatgcgttcaacaggcgttgcggatgatgtattttttggtcctgaaccagagtttttcttatttgatgatgtgcgttttgatgtctcgatgaacggtaactcttatactgtcgacgatattgaggcagcatggaatacaaataaacactatgaaggtggaaataaagcctatcgtcctttgaagaaagggggatattgtgcagttgcaccgaatgatatcgcacatgatattcgctcggaaatgtgtttgttaatggaagaaatgggattagtgattgaagcccatcaccacgaagttgctacagcggggcaaaatgaaattgccactaaatttaatacacttacattaaaagcagacgaaacgcaaatttataaatatattgtgcaaaatgttgcgtatgaacatggcaagacagcttgctttatgccaaagccgattataaacgacaacggttcaggtatgcattgcaacatgtctttgagtaaggacgggaaaaatattttccaaggtgataaatatgcagggctttctgagaccgcactttatttcattggggggattattaagcatgcaaaagccttaaatgcgtttaccaacccatcaaccaactcttataaacgcttagttccgggatttgaagcacctgttttattggcttattcagcaagtaaccgctctgcatcaattcgtattccggcggttactaatcctaaggctattcgtattgaagcacgtttccccgatccgttggctaacccatacttagcgttttcagcattattaatggctggtttagacggtattcaaaacaaactttatcccggtgatgcaatggacaaaaacctctatgatttaccgccggaagaactgaaagacattcctgccgttgcaagttcattaagtgaagcgttagataatttagaaaaagattatgaattcttaacgcatggtaaagtattcagcaaagaatttattgatacgtttattgcaatgaaacgtaaagaagtggaacgtttaaatatgacaccacatccagtagaatttgaaatgtactacgcttaatactggttagataaacaaaaagcgactaaatttgtttgagctgacctcacaggctagacagatttaatgcaaggactgtgttatatcatttacaggtcgcagtccttttagtttcacgtgaatatattcaaattgttgtaataaagtatctgaaattttcccgactttactctgataagaggatactttcttcgctggcaattcttaattttataccgcactttttactctttttttctcagcgaaacttctcctccgttaaattttctcaatactccattattcaacgctactaatagataaccctcttcatcaataccttgctcaattccacaaacgatttctttttcgctaataatatttacttcttgtccaaaaaaataatccaacttaatccaacgctgaaaaaaagcatgcattccctgttgctcaaaaatagtcaaatattgataccatttttttactaattgaattgcaagatcattacgatctatttccggcaaagtttccaataattccgcccaaggttgatcaattttgttttcttgcggtaaagataaatttatcccaatgccaacgataaaattaagtaatccatttttagcattgacgatttcaactaaaattcctgctaatttccgtccgaacaatagcagatcattcggccattttaacttaacctccgcacccatttcatttagcacttcagcagttgccagtcctaatactgaacttaaaccgtttaacgaaactgtcggattgaatgtccaataaaaactcaccattagttgaccggcaaaaggcgattgccattcccttcctcgtctacctcgccctgcaaattgatattcggtaaaacacaagtcccctttgttcaactgtaaaatgttttccatgagatactgattagttgaattgataatagggtgataataaatcttataaggacttaattctgtttccaaataagatagatttaataaaggaagttgcggttttaaagaaatattttgctcattatcaacaatacaaattccttgttgtcttaattgtgctatctgcttttccagttgtactcttgtcaggtctaaaagtgcggttaaatttttgtaagaatagggtttgcatctagctaaaatagataacaacttaatcatttttccctcgctatcaccattataaaatctcaagcagcagtacttttaacacaaattttttcaagagaaaatattataaaaaaacattttcaaacaagtatgagatctgtataatcccgacgcaatattttttatcctttttaatcttaatagagagaatattgcactatgttacgcatcaaacaagaagctttaacttttgacgacgttctattagttccggctcattctacagtacttcctaatactgctaacctttcaactaaccttaccaaagaaatccgtctaaatattcctatgttatctgctgcaatggatactgttaccgaagctaaattggctatttctctagctcaagaaggcggtatcggatttattcataaaaatatgaccattgaacgtcaagcggatcgtgtgcgtaaagtaaaaaaattcgaaagtggaattgtatctgaaccggttaccgtttcgccaacaatgacgttaactgaattagcggaattggctaagaaaaacgggtttgcaggttatcctgtagttgatgaacaaaaagggttggtagggatcattacagggcgtgatacacgtttcgtttcagacttgaataaaactgttgcggattttatgaccccaaaagatcgtttagttactgtgaaagaaggggctactcgagaagaaattttccatttaatgcacgaacatcgtgttgaaaaagtgctggtagtggataacagctttaaactaaaaggcatgatcaccttaaaagactaccaaaaagccgaaagtaagccgaatgcgtgtaaagatgaatttggtcgtttacgtgtcggtgccgcagtcggtgccggtcccggtaatgaagaacggattgatgcgttagtgaaagcaggagtagatgttttgttaatcgactcatctcacggacattccgaaggcgtgttgcaacgggtacgtgaaactcgtgctaaatatccaaatttacctattattgcagggaatattgcaacagcggaaggtgcgattgcattagctgatgcaggggcaagtgcggttaaagttgggattggaccgggatcaatttgtacgactcgtattgtaacaggtgtgggagtgccacaaattacggcgattgctgatgctgctgaagcattgcgtgagcgtggtattccagtgattgccgatggtggtatccgctattcgggtgacatcgctaaagcgattgcagcaggtgcatcttgtgttatggtcggatcaatgtttgcaggaacggaagaagcaccgggtgaaatcgaactttatcaagggcgagcatttaaatcttaccgaggtatgggttcccttggtgcaatgtcaaaaggatcttccgatcgttattttcaatccgataatgctgcggataagctagtgcctgaagggattgaagggcgtattccatacaaaggcttattaaaagaaattatccaccaacaaatgggtggattacgttcttgcatgggcttaaccggctgtgcgactatcgaagaattacgcactaaagcccaatttgtacgtatcagcggagcaggcatcaaagagagtcacgttcacgatgtgaccattaccaaagaagcaccgaattatcgaatgggctgatataacaaacggttggtttttgcaaaatttgcagaatttgtgtcgcttgtactgagataaggagcataaaatgaaaaaattaggtttgatttctatactgttattgtccggctgtggcatttttggtccatcatattcagggcaaacaacagcagactggttattaaaatcagatacagaaagcactattaggctatattttcgtgctataaataattgtggaatagaaaaaatccatacggaaatcaattcaataccgagtgcaggtaatgtaaatgaaacttggactgtaacaggctgtaatataacaaacgtttttaatgtgaaatatgttagtgacggtcatggcgggacttactttcgcgtatctaaaaaataaactaaaactttaggaaacaaaatgacaaatatccatcaccataaaatcctcattttagatttcggttcacaatatacgcaacttatcgcacgtcgtgtacgtgaaatcggggtgtattgcgagctttgggcttgggacgttacggaagaacaaattcgtgagtttaacccaacaggaattattctttcaggcggaccggaaagtacgactgaagcgaatagtccacgtgcaactgaatacgttttcaatgcaggtgtacctgttttaggtatttgctacggcatgcaaaccatggcaatgcagttgggcggtttaacagaaacttctacgcatcgtgagtttggctatgctgaagtttctctacaaaatccgaccgcactttttgcagatttaaacgatgatctgaccgcttgcgatccaaaattggacgtttggatgagccacggcgataaagtgactcgcctacctgataatttccaaattacaggcatgacctcgacttgcccgatcgcggctatgtcagatgaaagccgtcgtttctatggcgtgcaattccaccccgaagttacccacacaaagtgcggtcaaaaattactgcaaaattttgtggtagatatttgcggttgcgaaaccaattggaccgcagaaaatatcatcgaagatgcagtggctcgcattaaagcacaagtgggcgatgatgaagtaattttaggcttgtcaggtggcgtggattcatctgttaccgcacttttattgcatcgtgccatcggtaaaaatttacattgtgtctttgtcgataacggcttactccgtctaaatgaaggcgatcaggtcatggaaatgttcggtgataaattcggcttgaatattattcgagtagaagcagaagatcgctttttagaagcattaaaaggaattgatgaaccggaagcaaaacgcaaaactatcggtaaagtattcgttgatgtattcgatgatgaagcaaaaaaattaactgacgtaaaatggttagctcaaggaacgatttaccctgatgttatcgaatcggcagcaagcaaaaccggaaaagcccacgttatcaaatctcaccacaatgtaggaggcttacccgattatatgaaattaggtttagttgagccattacgtgaactcttcaaagatgaagtgcgtaaaatcggcttggcacttggcttgcctgcagaaatgcttaatcgccacccattcccaggccctggattaggtgtacgtgtactgggtgaaatcaaaaaagaatattgcgatttactgcgtaaagccgatgcaatttttatcgaagaactgcataaagcagattggtactacaaagtcagccaagcgttcagtgtcttcttgccggtaaaatctgttggggtaatgggcgacggtcgtaaatatgattgggttattagcctaagagcggtcgaaaccattgactttatgaccgcacattgggcaaacctaccttatgatttattaggcaaaatctcaaatcgcattatcaacgaagtcaacggcatctcccgtgtagtttatgacatctcaggaaaaccaccagcaacgattgagtgggagtagctaaaaatctaaagccttataaatagacattttgtgagtgttgtgcttgcaataaatcacctgaaggataattcttcgggtgattatactattaattcagggactgtattagattagccctaaatgacacacattttcgtagtgtttttaactgctctttagatattccaaagacttacattccttcaaaaataaaggagagtttattcggtcaattccattgtattttcagagtattcgtttggcttagcccccaaattttctatgtcgttgatgtagtcttgtttgactgcccccgaaatgattaattctttcgtggtgaaattcacttacatcaagggctaaatgataacggattagctcatggatgtttcgataaaacaatgcacttgaattttgatttatacctaaaatatctgctgcggatcgtgctgttacttctagcacaaaaaattcaaggagctttttctgtatagatttctttaatttacaatgagttgtcttcatttttatagactagcatacttgctaatctaatacagcccctttttttatattgatgagtttgatagatagacactatcctaaaaaatcacaaaggcagcttaattctacaggtgataagattggaaatcggaagcttggtagagaagcaatttaaaagatatatcaatatcataattgcccgaattttcgctaaaaacgtaatatcgggcaaattatatggcattgtaaagagaataaatgtgaagcagttcacattctatacacaaattattgctgtatgatgaaataatttgttttattttatatgagaattgaaaatatatttcaaacttgtttcgtaatatataaagaggagtttgttatatgaatagtaaatttaccccccccctctccatttccacgcctgttgggaatctattaaacagcatcaagttcctgaatggtatgaagatgctaaattcgggatttttattcactggggaatttattccgtccccgcgtttgcaccaccgacttgtcaattaggtgagatcgatattgacgagcaatggttctgtaacaatccatatgccgagtggtatttcaattcaattaacgtcaaaaaaggtccgacttacgagcatcatatcaaaacctatggtgaagatttcagctatgaacagtttattccacaatggaaagcggagaagtggcaacctgccgaatgggcggagctgtttgccaaagcaggtgcaaaatatgtggtgctgaccaccaaacatcatgacggtttctgcttatatccaagtaaatataccgatttcaactgcactgaagctggtccacaacgtgatttgatgggcgagctgactgataatgtgcgtgaaaaagggctgaaaatgggagcttactactctggtattatagactggacctactcttctgcaccgattttcaccgagagtcaaaacttttccaatgcttgcccaacctatgaatacgccgattacgcttataaacaagtggttgagctgattgataaatataaacctgatgtactttggaatgacatcggctggccgaaagccggtgaacatatgcttccgcacttgtttgctcactactataacagcgtgccacacggtgtggttgatgaccgttggaacaagctctggtgcgatttcacctcaaaagagtacaaacacggcgtggcttcgcgtgataaaaaatgggaaatgtgccgtggtatgggcttatcatttggttacaacaaagtggaagatgaaagccacttgatttcagtgaaagatctgatttcgctcttagtagaaaccgtggcagacaacggtaacctgttgctcaacatcggcccaaaagcagacggtactattccacaagagcaagttgaacgcctactctccttgggtaaatggttggagcaaaacggtgaagggatttatcgctcccgttgcagtaaatattcccccgaaactgtaaacggtgtaacaatgattgcccgccctcagatcgaccaaaatcgcacgtcttaatcgttccgagtgctgtatcgttacaacaaacagcggctgtttaaggaatccatcagcagcgtgggcgtgttgaaaactgtttgcattccttaaaaaaatacatataacaataatttttatttgcatattttatataatataagaaaggatataggtaaatgacctctttcaaattattaggcttttcggtcttgagtgtggctttgctctctgcctgctcttccggcaaaggtggctttgatttagacgacgtcgagcatacccccccctcctcctcgggtagttcccgccccacttatcaagatgttccgactggacaacggcagcaagaaatagtagaagaaatcaactcacctgctctaggttatgcgacagaaattccgcgtaggaatatttcgccaatgcccaccacgggcacaaaagaaagtaatgctcgtgttgccattactgcccagcaagttgcccctcttagcatgccttttaattcaataaaagaagattttatcaaaaggctaatagcagaaaacaccaagaaaaatgcacgaggtagagatgtaaaatattttgatgatacagatgacgtgttgtttgcacatgatggatctaatttagcgcataaacgtgatttacaatatgttcgagttgggtatgtgttgggtacccgaaagattgaacttgttttttcccatgataaaaaaacaagagatcaatttcctgctggttgggtaggttatgttttttaccaaggcactagccctgcggttacattacctacacaaaccgtaacatacaaaggctattgggattttgttagtgatgccttcaatgaacgaactttagctgaagattttacacaggaaaatagttctgctactagcaatataccgggcaatcaaatcggtgcgacttcaatggatgcattggttaatcgcaaagtttcaggagaaaaaatcaatattgctcacagtgctgagtttactgctgattttggcagtaaaaaactttcaggtgaattaaaaagtaacggttatgtttctagaatagaaaatgagcaacaagatgtaaaaacacgctacaaaattgatgctgatatcaaaggcaaccgttttgtcggttcagcaacagcacaagaaaaaagtcacaccatcttcggcaaggatgcggacaaacgtctcgagggcggtttctttggtcctaaagccgaggaactggcaggtaaatttctgaccgatgataattccctgtttgtcgtctttggtgcaaaacgtgaaagtaaaggcgatgaaaaactagaaacccgctttgatgccgttaaaatcagcacggatagtaataaattagaaaaagaaacgatggatacgttcggcaatgcggcgtatttagtgttggacggcagacagtttcctttggtgccggaaagtaatgccggtacgacgggcgctggcaacacaggcaagaatgagtttatcagcaccatagacggtagccatttaaacaaaacaaatcatgaaaaccacaaaaaatacaaagttaccgtatgttgcagtaatttggtgtatgtgaaattcggcagctatggggaacaaacaacagcaaacgatgcttcaaacagcactgccggtgcagcaactacgcataacagcacattaacaaacggacaccttttcctaacaggtgaacgtacttcgcttactgatatggcgaagcaaagtggtgcagcaaagtatattggcacatggcaagccaactttttaagtagcaaaggacaggttggcagtgttgacgccggtgatccgcgtaacgatagtggtaaaagccgtgctgaatttgatgttaattttggtggtaagacagttacaggcaagttttttgatgccgacggtattcaacccgccctcacaatggatagtaccaagattgaaggtaacggcttctcgggtacagctaagacaactggtagtttgcaattagataaaggcagtacaggtgcgggtataacagtaaccttcaccgatgctaaagtcgatggcgcattctacggtccgaatgcagaagaaatcggcggtaccatcacatcgaatggcacgggcgataaagtcggtggggtgttcggtgcgaaacgccaagaactatcgcaacagaaatgaaatcttaactctagctacctgaaacatatttcaggtagcaggatgggtatctgctgatatgctcaacctgcttgaaaaagtttgtcaaatccgccgcctgtcgttgttgacggtgtgatgttgcagtggcaaatcgctcggctttgttgagaaagcatgacccatccgtcttttactcacacggaacgaaaaaaatgtctacaaaacctttgtttaaacttaagctgataacattggctgtcagcacgatttttttaccttttactgaggcggttgccgatactgaatcaccgagtagcaatacagaagcagtgctggagttagaagctatccaggtgcaagccaaacacgagatcagcagacatgacaatgaagtcaccggtttgggtaaggtggtcaaaagcagtgaagacattgataaagaactgattttgaatattcgcgatttgacccgttatgatcccggtatttcggtggtggagcagggacgtggtgcaacgtcaggctatgcaatgcgtggtgttgacagaaaccgcgtggctatgttggtggacggcttgggacaggcgcagtcctattctaccttgaaatccgatgccaacggcggggcgattaatgaaattgaatatgagaatattaaatcaattgaattgagcaaggggtccagttcggcagaatacggtagcggtgccttgggcggtgcggtagggtttcgtaccaaagaagctgatgatgtgattaaagaggggcaaaactggggcttgaacagtaaaacggcttacagcagcaaaaacagccagtttacccaatccgttgccggtgcgttccgtgtcggcggttttgacagtttggcgatttttacccatcgtaaaggtaaggaaacccgcgtgcatcctgctgccgaagaaatacaacatacttaccaaccattggaagggtattttaatcggtatgaggttgaccaaagaaacggaaagcctgttctggcgaatgcgtattatatacttgccgatgaatgctctaatctaagtgatccgagttgtcgtcatgccaaggccaagacgaatagggtgggtgccccggagaacaatcctaattggacgcccgaagagcaggcacaggctgctaaaatgccgtatccgacacgtaccgcctctgccaaagattatacgggtcctgaccgcatcagccctaatccgatggactaccaaagtcactctttcttctggaaaggtggttaccgcttgtcgcctaaccattatgtcggcggggtgttggaacatacgaagcagcgttacgatatccgtgatatgacgcaacgggcgtattacacgaaagaggatatctgccacagcggatccagttgccaaacgttggataaaaatgagacggacaaaggtaatttcggtatcacgttgactgataatcctttggacggtttggtatatgatgccggcaatcaagctcgtggcgtgcggtacggacggggtaaattttttgatgaacgccatacgaaaaatcgctcgggtattttttaccgctatgagaatcccgataaaaattcttgggcagatagcttgaccttgagtattgaccgccaagatctcaaactgtcgagccgtatccattggacgtattgcaccgattatcctcatgtggcacgttgccgtgccagcttggacaaaccttggtctaattaccgtaccgagaaaaacgattatcaagaacgactcaatctgggacaattcaattgggaaaaaacttttaatctgggctttaccacgcataaggtgaatatcgccgccggctttggtacacatcgctccaccttacaacatggcgacttatatgctgaatatgtcaccttgccaccgtatgaggaggaaaaagtgtatgaagataaaggtgcctttaaaacagatccgacagcagaggagaaattacaatacggcaatggttcttatgacaaacctcgcgtatatagacgtaaaaacacgccggaattaaaaactgtcaatgggtgcaatgagacagcaggcgataaccgtgactgctcgccacgtgtgattacgggcagacagtattaccttgccttgcgtaaccatattgcctttggtgaatgggcagacttggggttgggcgtgcggtacgacaaccataccttccgctcgaatgacccgtggaccaaaggtggcaactaccacaactggtcgtggaatgcgggcgtgagcctcaaaccaacccgccactttgtcgtgtcttaccgtgtgtccagcggtttccgtgtccccgctttttatgagctgtacggcgtgcgtacgggggcttctggtaaagacaatccactcacacaaaaagagttcttgagccgtaaaccgttgaaaagcgaaaaagcctttaaccaagaaattggtttggccgttcagggagattttggtgtgatagagaccagtttcttccaaaacaactataaaaacctgcttgcccgtgcagataaacatgtcgagggattgggttatgtaaccgatttttacaacacccaagatgtcaaactcaacggtatcaatatcttgggtagaatctactgggcaggcatcagcgataggctgcctgaaggcttgtattccacacttgcttacaaccgtatcaatatcaaagcacgcaaattgcacgacaattttaccaatgtgtctgagccgacattggaagccgtgcaaccgggacgtattattgcaagtatcggctatgatgaccctgagggcagatggggccttaatttaagcggcacctactctcaagccaaacaacgtgacgaagtggtcggcgaaaaagtgttcggcaagggtggcagcattaaacggacgatcaacagcaaacgcactcgcgcttggtatatttatgatttgacggcatactacacttggaaagaaaaattcacgttgagagccggtatctataatttaaccaatcgtaaatatagtacatgggaaagtgtgcgtcagtccgctgccaatgcggtcaatcaagacctaggtacacgttcagcacgttttgccgcaccgggcagaaactttaccgtgagtatggaaatgaagttttaattaaaaaactgtctgcaagctgtttaaaaaacagttgagatgatttgttcgtataaatagctgcttgaagtcttgttatgcaggttcaggcagcttgacattccaaaaaaaggaaaaaagtctaatggaagacaatatgctatttgtcggcaacgaaattaggcaacgaaaaattgttgcaatggattagcagttcaagtggcttccggtattttttatcgcactttttctatctataagcttgaaatctttatttccgaacttatattttcgctgtttgttaatttcactattggaaaaggaaatattatgtcaacaaatcaagaaactcgtggttttcagtctgaagttaaacagcttttacaattgatgattcattctctttattcaaataaagagatttttttgcgtgagttgatttccaatgcgtctgatgcggcggataaattgcgttttaaagccttgtctgcacctgaattatatgaaggagatggtgatttaaaagtgcggatcagttttgacgcagaaaaaggtacgttaaccattagcgataatggtattggtatgacgagagagcaggtgatagatcatttaggcactatcgctaagtccggaacaaaagaatttttggccgcacttggacaggaacaggctaaagatagtcagttgatcggacaattcggtgtcggcttttattcggcatttattgtggcggataaagtaacagtgaaaacgagagcagcaggtgagccgatagatagagcggtgttgtgggaatcagccggtgagggtgaatattctgttgctgatattgagaaaagagaacgtggtacggaaattactttgcacttacgtgaagaggaaaaagagtttgctaatgaatggcgtgtacgtgaaattatcggtaaatattctgatcatattggcttgcctgttgaaattttagcgaaagaatatgatgaagaaggtaaagaaacgggaattaaatgggaaaaaattaataaagctcaagcactttggacaagatcgaaaggtgagatttctgatgaggaatataaagagttttataaacatttaagccatgattttgctgatcctcttttatggacacataataaagttgaaggaaatcaagaatataccagcttgctttatgtgccgtctaaagccccttgggatttattcaatcgtgagcataaacatggtttgaaactttatgtacagcgtgtatttattatggatgatgctgaacaatttatgccgaattatttacgctttatgcgtggcttaattgatagcaatgatttgccgctaaatgtatctcgtgagattttacaagataataaagtgacagctgctttacgtaaagcattgaccaaacgctcattgcaaatgctggaaaaattagccaaagatgacgaggagaaatatttacaattctggaaagaatttggtttggttttgaaagaaggtccatcagaagactttgcgaataaagaaaatattgccaaattattgcgtttcgcttccagtaaaaatgatagctcagaacaaaccgtttctttggaagattatgttgctcgtatgaaagaggggcaaaaggcaatctattacatcactgcagatagttatattgctgctaaaaactcaccgcacttagagctgttcaataagaaagatattgaagtattgttgttgtctgatcgaattgatgaatggatgttaagttatttaactgaatttgacggtaagcaattacaaccgattactaaagcggatttggatttaggcgatttggcggacaaggaacaagaagagcaaaaagagcaggataaaacctttagttcgtttattgaacgagtaaaaaccttgttgggagaacgagtaaaagatgtgcgtttaacgcatcgtttaacggataccccagcagtggtttctactgataatgatcaaatgaccacgcaaatggcaaaattatttgctgcggctggacaacctgttcctgaagtaaaatatacgtttgaacttaatcctgaacatcatttagtgaaaaaagtagcagatttggctgatgaagacgaatttgcaaattggattgaattactgcttgagcaagcgatgcttgctgaacgtggttcattagaaaatcctaccgcatttattaagcgagtaaacaatttattggggtaatggttgtttcttagctgattgatgtaataaaactctctaatttattagggagtttttttatctatgtttgacacttgtagtaaaaaagtgcggtagtaaaatagcatttgaatagttaaaaaaatgctaacaatggaattttcacgtataattcgaagtcgggttttattgactttttattgaaggattgttgatgaaaaaaattatcttctttggaactgttatttggttaactgcttgtaccacaaccaatttatcatcaagttgccagcgttattttagtatactggaaaaaaatatggcacaattttccctatcaagttctgaactagccaagtttaaacaaaataaaaataaattaagtcaattgccggaaaaagaacaaaataaaatttgccttttaagaatggcaaatattcaacagtatagaaattgattgtttctgatgtgttcaagtttttttatggaataaatatgactacgttcgtcgcttggggcaatattcaacaatattatccttttgaaacaatacctttgcggttgctaaataaaaacctaacgcattcagcaagtaactataaacctgtgcagcaacgttatcattgtcgccgtttagcacattttttattgtggcaattgttacaaaaagctggtgttaataccgcacttttaggtgatattaagcgttctccatccaatcgtccttactttctacaagacaatattgattttaatatcagtcattctgatgattgggtagcagttgttttacaagttgatgaaaataatgataaaagtgcagtaggaattgatattgagtttgccaaaaaaacaagaaattacgccgcacttttacagcattttgccagacggcaagaggtgatttggtttcaacaaaagccttgtgaggaacgtttttatcaaatttggtgcggacgagaggcgttattgaaatcgcagggcgtaggtattgtcaaattatcggaagtcaaccatgtgccggagaaattattactttattccgattattgcccaacgggaaagcttatatttacggcggagttgcctttttattttgctcttttttgtcatcaacatattgaacaaacacaatattttatgtggcaagataaccggtttgtttcaaaaaaactgacgcagacaattgaatatcaagtgaatcctttaaagcagttcattcaaatttaaagtcggttttcgttgcataatgaaaatgaggtagagtattgctcaaattgaatttacgaagattaaattatcaaaggacaacagagtcatcgtgaaattgcggtagaaattcaggactttttaagtggtaacaaaaagcctcatcaataaaaatgaattgataaggctagaaaatttggtggagataatcgggatcgaaccgacgacctcttgaatgccattcaagcgctctcccaactgagctatatccccgtaaatcgaatgtggcggctatgataaattccgccacttgtgctgtcaatatagaatattaaatattttttttactagattaaatattaaacattttgtgtatgaataaacgcaattgcattatttattctgctaattgtgcgatctttaccaaccaatttcgctgtaatatccattgacggtgattgtcccaaaccagttactgccaatctaaatggcattcctactttacccataccgatatcaagctcttgggcggtttggctcattacttcatgaatattttcaactgtccagtctgaaagtgcggtgagtttttctgccaatttagctaacggtttaatcgcttcaggcttgaagtttttagcaacagctttttcatcatagttttcaacatcttggtagaaataacgacttgagatggctaactcttttaatgttttgcaacgttcgcttaaaacgggaataatttcagctaagttcggaccattgctataatctatgccgtgttttttcatatgccattctagatgggttgcgacctgctctaccggcagagaacgtatataatgctggtttagccattgtagtttttcagtattgaatgcacttgctgatttgctaactgaatgaatatcgaaaagtgctatcatttcttctcgactaaaaatttcttgatcaccatgtccccatcctagacgaacaagataattgattagtgcttcgggtaaataaccttcatctcgatattgcataacacttaccgcaccatgacgcttagataatttttgaccatcatcaccattaatcatagatacatgagcgtaagtcggaattggtgctcccaatgctttaagaatattaatttgacgaggcgtgttattgatgtgatcttcaccacggacaacatgcgtaattcccatatcccaatcatcgacaacgacacagaaattataggttggcgaaccgtctgtgcgacggataattaaatcatctaattcacgattgctaatttcaatacgcccacgaacggcatcatcgaaaacaactgtaccttccgtcggatttttaaaacggacaacgtgaggtgcatcaactggatattcactttgatgtaagcagtagcgatcatagcgaggtttttgtttattttgctcttgactatgacgtaggtcttccaaacgttctttagtacaataacaacgataagccaatccttgctcaatcatctgatcgattacttggttatagcgttcaaaacgttttgtttgaaaatacggtccatgttcccacgctaaattaagccattccattccctctagaattgccgctgttgcttcaggggttgaacgttctaaatccgtatcttcaatgcgtaatacaaattctccttgattatgcttggcatacaaccaagaataaagtgcggttcttgcaccgccaacatgtagatagcctgttggacttggtgcaaaacgtgtacgaactttagtattgggatctaaattaaaaagtggttctaatttcattcattttgcctttatttaatcaatcataaaacggtgcttattgtacaatgagttatttaatttcataagaaaaaattaaaattatgtttatttttaagacagttaaatagaaatccataaaaaatcattgactgttttttgataattcttataatgcacctcgcacaatacaagggcgattagctcagttgggagagcacctcccttacaaggagggggtcactggttcgagaccggtatcgcccaccactattctatagtgaactttgtattgtaatattggcttaaggggcgattagctcagttgggagagcacctcccttacaaggagggggtcactggttcgagaccggtatcgcccaccactttagccggatttcccatttgactttaagtcaaatccgatagctgaaaagcgattcgattctatcgggcgattagctcagttgggagagcacctcccttacaaggagggggtcactggttcgagaccggtatcgcccaccaattcaaaaaatctaaatttttccacgttgttaaacttattacaactttcgggttgttgtcttttttatctatatttttaactaattattgttcacttttgcgatcttgatcgtaaaactacgatacttgcaaaaaagttttttcctgattccattaaaattattttttatttaacgaataggaaaacatatgcagaatttgaagctattttcttggaaagccactaattttttacagcaaaaacaagctggaatgcttgttatcgaaaatgtacaagaggccaaacgctatttattacaacaagggctaaacaatatatatttacagcgtcattggcaactgaataaaaagcctaaaaaaatagaattttgtgatctattaactcaattagcaatgttattacaatcctcaattcctttaaaagatagcttacaaattttattgagaaattgtgttaatatttctttaaatcaatgggttagatatattttaaaaaatcttgaaggaggattatctttttcacaatctgtggctcaatcaggtctatatttttcttatcaagaacgccaactcatttctgttggagaaatgacgggagatttagcctctgtttgccaacaaatagcagaacatcgtcagcaggcattagcattacaacgcaaaattcaaaaaattttactctatccaatgatagttttaagtatttctatcattctcaccgcacttctattaatttttatcgtgccacaatttgccgaaatgtacggttctaatcaatccgagcttcctttttttacgcaactattgttaaacatatcctcttttttacaacagtatttttttcatatgatagcggtatctattttatttttttatctaataaaattacgtttacacaattcatatagttttcaactcaaaaaagattggtttttatcgcatgtgccgttgttaaataaaattattcggcttaatagaacgataagtttttgccgtagtttaggattaatgctcaactcaggcattcctttacaacaaagtctatattctttccttccccaaaactctatcaacatacagaaaaagattgagggagatctcacgttaattaatgaagtaaagctaacattacgtggtatcgaacaaggatataaattctctcagtctgtaagcagtaatttgttttctatacaaacacaaccaatgctacaagttggtgaaaagagtggaaatctaggtttaattctgcaacatatcgcagaaaatcagcaacaacagttagatcatcaaattgatttactttcacaaatgttagaaccgtttatgatggtgatcattggcggattaataggtttgattatgttaggtatgtatttaccaatctttaatatgggaagtttaattcaatgatttatctggcttatatgttgtttggtgggctttgtggcttatgggtttacctttatgtcaggcaattttctgctcagattaataaacaagtttactcgactttttgcgaaattttccccgaaaatgcaccgcacttgatgcctatgtctatcttacgacggaaaaagtgcggtcatttttctatgtattttttgtgtggtggcctttggtgtaatatatgtttaaatttcccacaaaatatttatgttggtttatggttagcatgttgcggttatttaattttttgccttgttttagtggattggctataccaactcgtttcacaaaccttatgccaagccctatttattttagggttattgggtgcttatcaaggtattagcccattgactttggagcagtctttaattggtagcttatcaggtttttcggttttttatcttatttacattgttgcaaaattattctatcgttatgaagctttaggacgtggcgattactggttaatgttagggttagggagctttatatcttggacaaaattaccgttgctcatttttcttgcctgcctcacaggattaatatatgtcgtttttaatacaagagacaaaaaaacaatatttattccttttgccccattcttatgtctctcaaccattatcgtatacttgcttaattttctaagggaggatattcttccttaaattttagggaaagaagaatatggcttatattgtagggttaaccggtggtatcggtagcggcaaaagtaccattgcgaatcttttttcagaactaggcgtacctattgtggatgccgatgttgtcgctcgagatgttgtagcaaaagattccttaatcttagagaaaattattgctcattttggtgaagaagtgcggttggaaaatggtgagttaaaccgatctgaattgcgtaaattggtatttcaaaatgaaaaagaaaaattatggctaaataatttgttgcatccggtaattagagaaaaaatgctgcaacaattacgctctgttaattatccttatgtgctttgggtcgttcctttactcattgagaataagctaatgaaattatgcgatagagtactggtaattgatgtagagcctgaactccagattttacgagcaagccggcgggatagtaattcggttgaattaattaaacaaatgatacagtcgcaagtaaatcgtgagttacgtttaagttttgctgatgatgtcattgaaaataatctaccccttgaaaaaaacgtggctaatttaaaacaaagcgtagcaaaattgcaccgcacttatttgcattatgcgaagataatttctagaaatagtgaagaatttgaggatataaaatgattgatgaaaaatttactgtagcctgtcccaattgcaaaaaagaagtactttggtcagaggaaaatcgatttcgtccattctgtagcaaacgttgtcaattaatcgacttaggtgaatgggctacagaagaaaagattattcccggttcagaaataaccttgttaccgaaagatgaatttaaagaaaattgagagttatgaatggatagataaataaatagataaaaagaatattgagattttaatttgggcttgttagaatcagcccacttttattttgataaataaaaatatagttcgaatgaaggtagctggagaatggggaattgaccccaaaccgacgaggtaaaatctttcaggtgcgatggcgaggactgttactggacgaacccttggagagatccaatgtgcaatgcacaaaatggacgccgaaggcgcaaaagagcggtgttttttactgcttttcaaacgctcaggcaaaaggacaggggcaaaagattcttttcggatagaaacgttgcatagcgttttttctttattatcccaaaaacttttcgcctccttgtaaacacacgttattttacgaggaatacttatgtcattagagataattttatcgtctatcaatacttttgtttggggacctcccttacttcttcttttatttggtacaggtctttacttgaccttacgcttaggatttattcaaattcgttacttacctcgtgcattatattatttatttgataaagaacgtcatgtaagtaaaaaaggggatatttctgctttcgcagccctttgtacggctttagcggcaacaataggtacgggaaatattgttggtgttgcaactgctttgcaagccggtgggccaggggctattttttggatgtggttagttgctttacttggaatggcaactaaatatgctgagtgtttattagcggtgaaatatcgggtgcgagataaacaaggttttatgagtggcggaccaatgtattatattgagaaaggcttaggaataaaatggcttgccaaattttttgccgtctgtggtgtattagttgcatttttgggcattggcacttttcctcaaattaatgcaatcacgcatgctatgcaagatacctttaacgtatctattgaaattacagcaaccattattaccgcacttattgcacttattatcttaggcggtgttaaacgcatttcaacagttgcatctattatcgttccttttatggctgttttatatgtacttacgtctttgttaattcttatactaaattggcaacaagtaccaaccgctattggactaattatttacagtgcatttgatcctcaagcagcattaggcggtgtatttggatatactgttctgaaagctattcaatcaggatttgcaaggggtattttctctaatgaatccggattaggtagtgcaccaattgcggcggcagcagctcaaactaaagaacctgttcgtcaaggattaatttcgatgataggtacttttttagatactatcgttgtatgtactatgacaggtatcgtgcttgttttaacaggtgcttggcaatcacaagaattggctggtgccgctttaactaactatgcattttcacaagggttaggaaataatattggtgcaacaattgtaactgtagggttactgttttttgcttttaccactattttaggttggtgttattacggagaacgttgttttgtttatctggcaggtgtcaaaggtatcaaagtttatcgttcaatttttatacttttagttgcctgtggtgcttttattaaactggaattaatttggattttggctgatattgtgaatggtttaatggcatttccaaatttaattgctttagttggattgcgacatattgtgatcaatgaaactaaagattattttattcgcaggaaacaaatatttgttgagccaaataatgtagctaattgagcaaaaattaaaggggctgacgtcccctttaaatttctctacatcagaccatcatatcaacctcaaataaaaataaaagtgattttttataaatatgataagtagatcatactttttcatttttattcctaaaaagtgaaaaaacaccttgaaaactcctgctaagaggactattttgtaactaagaatttttctgagtggaaacgctcatcaataagcaaaagaggtaaaagctatgactctaaatatcacaagtaaacaaatggaaatcacccctgcaatccgttcacatatagaggaaagacttgctaaattaggaaaatggcaaactcaattgattaatccgcattttattttaaataaagtaccgcagggttttgctgttgaagttgccataggtacgccttatggcgatttatttgcaagtagcgagtctgatgatatgtacaaagcaattaacgaagttgaagaaaaattagaaagacaattgaataaattacaacataaaggagaagctcgccgagctagtgaaagactaaaagacttgttttgataaatgagtttgtctaaaagtagagtgaaaataaaacgctctatttattgcgtaatgaattttacttattgtatgttacctatttgaacctaccaaataagtagtgtaaatcgtggcttctcgtaagtcctaaaaaagctgatgtttaaacttcagcttttttgttagaatatatcggcgataaattttattaaggaatgaagatgaaaaaacatcatgttgacgttttaattactgaggaagatgtacgttcacgtattcaagaattaggtagagaaattacacaattctatcagcataaacacgtaaataaattggtagttgttggattattacgtggttcatttatgtttatggctgatttagtaagagaaattaaattaccgattgaaattgaatttatgactacttccagttatgggaatgaaatgacaactaatcatgatgtacgaatagctaaagatttagatggcgatattaaaaatgaagatgtattgattgttgaggatattattgatacaggatataccttagaaaaagtgcgggagattttattgctacgttcgcctaattcattagcaatttgtactctattagataagccatctcgccgagaggtagacgttcctgttgaatgggttggatttactattcctgatgaatttgttgtcggctatggtattgattatgctcaatgttatcgtaatttaggctatatcggtaaagttactttggaagaataagttaccgaaaaggaaatgtttctatcaaaaattaaacaaaaaaagagattaaaaaatctctttttttacacattctttaagaaaaaataactatatagataaaattgaaaataattagaaattatcttcaagcattgttaacttttttctcaaagcgttcagcagcagcatcccaattcaccacattccaaaatgccttgatataatctggacgacgattttggaattttaagtagtaagcatgttcccaaacatccaataccaaaatagggaaaccttcgcaaccggcaatttcttttcccattaatggactatcttggtttgcggtagaaacaacttctaatttgccttgatttaatactagccaagcccaaccggaaccaaagcgagttgcagcggctttctcaaactcagcttggaaactctctactgaaccaaaatcacgctcaatagcgtcttttaatgggccttgtaaagttgtacctgtttttaaacctttccaaaataaactgtgatttacatgcccaccaacattattgcgaatagcagtacgtttatcagcaggaacttcgactaatttggtaattaattgacccggacaaagatctgtaaactcaggtaaagtttctagtgctgcatttgcattattaacgtaagtttgatggtgtttactatgatggagttccatagtttgtgcatcaaagtgcggttctaaagcatcataagcataacctaattcaggtaaagtataagccataacaatttccttctataaaaaattctgaataataaactcggcgaattctagcaaaaaatttgatcaagatcattaaaagtttaatttttttaaaaagccctaccgtaagatagggctataatagattaaaaaacattcaacgattctgtgcttttaccgctgcaacggctaccatattaataatacggcgtactgatgaagcagaagtaagaatatgtgccggtttttccacacccattaaaattggtccaattgtaattggtgttgctgtaccttgtaataaattcaagctaatacgggcagtttccatgttgggcataatcaataagtttgccgcccctttaataggactgtcaggcatcacttccttacgtaaattctccgataaagcaatatcacagtgcatttcaccatcaataatcaaatccggtgctttttcacgcacaagctctaaaacctgccgcattttaactgcacttgggtcattaattgagccataatttgaatgtgaaacaagagcaacctgtggctctataccaaaacgacgaacttctttggctgacataatcgtgatttctgcaagttcctcggctgttgggcttgagttcacaaaagtatctgcaataaataaattaccggtaggcaaaaccagtccgtttaccgtagctggaatttcatgttctttttcaccaacaacctctttaacagtagccaagtgtgccgcaaatggtccaactaatccgcaaatcatcgcatcgactttaccaagttccaataaaactgcaccaagtgcggtcggattatggagcatttttcgtttggctccggtaggcgtcataccttggcgttttaatttgttgtaataagtatcacagcattcctcgtagtatgggttattttcaatgtcaataatctcaaaatcacgtccaacctgtaattgcagccctaattttttgatgctttcttcaataatatgagtacgccctaacagaacaggatacgctatgcctaaggttgcaatttcttggattgcatgtaatacacgtttttcttcgccatcagttaaaataactcgctttttatcttctttggcctgtgcaaaaacaggtttcatgaataagttggttttataaacaaactgggttaatttctcaatatatgcctcaaaatcttcaatcggacgagtagcaacaccgctatccattgcagctttagctacagctggtgcaattttgacaattaaacgaggatcaaaaggttttggaataatgtaatcaggtccaaaggaaacaccgctctcaccataagcagaactgacgacttcactttgctctgctaacgctaaatcagcaatagcataaactgccgcaagtttcatttcctcattaatagtggttgcactgacatctaaggcaccacggaaaatgaacggaaagcataatacattatttacttggttcggatagtcggaacgaccagtacaaacaatcgcatcaggtcgaacagctttggctaacggtggtaaaatttcaggctcaggatttgctaaggctaaaattaaaggattaggccccattgtttttaccatttcttgagtaagtgctccagcggcagaacaacctaagaaaatatctgaatctggaatggcatcagctaaagagcgttgaccgttatcatcaatagcatataactttttggtgtcatccattttttcgtcacgacctttataaatgacccctttagagtcacaaaccgtgatattttcacgtttcatgcctaatgaaaccaataaatttaagcacgcaatcgatgctgcacctgcaccggaggcaactaaacgaacatcttcaatttttttattaacaatacgcaatccgttaattattgcagcggctgaaataatggctgttccatgctgatcatcatgaaaaacaggaattttcatacgttcacgtaatttctgctcaatataaaagcattccggtgctttaatatcttcaagatttatccctccgaaagtcggttctaaagcagcgataatttctaccaacttatcaggatcttgttcatctacttcaatatcaaatacatcaacaccggcaaacttcttaaataaaacacctttaccctccataacaggcttaccggctaacgctccaatatttcctaaacctaatactgcggttccatttgatatcactgcgactaaattgcctctggaagtatatctataagcagagacaggatctgcttggatttctaaacaaggtacagccacccccggagaataggctaaagctaaatctcgttgtgttcccaatgattttgttggtgtaacttcaatttttcccggttttggaaactcatgaaaatctaaagcggcttgacgtaattgtgcatccataatttttccttatattaactatttacttcatttcaactttgctaaaaaccaattgcattatagacaaaaaaataggcaaaaaagtaacacaaaaattttatttacatattttaccaaattgtatgatatacagaattaaacacaaaaacaggcatatatttttactatatgcccattgaaactaaagagccattttacttatgtaatgtagctttgtaggttgggttcattaaattctccacagaaagaatattatctaactgctcttctgttaataagcccatttccagtacaacttcacgcactccacgtcctgttttagcacatgttttacctactatatcgccattatgatgaccaataaacggattcaaataagttacgattccgatggaattaaagacataattttcacaaatttctttatttgcagtaattccatcaatacatttatcacgtaaattcacgcaagcattcgttaaaatttcaatactttcaaacatggcttgaccaattaccggttccatcacatttaactgcaattgccccgcttcagctgcaaaagttacggtagtatcattaccaatcactttgaaacaaacttggttgactacctcaggtacaaccgggttgacttttgccggcataattgaagatccagcctgtaactcaggtaaattaatttcatttaaacctgcacgtggacctgatgaaagtaaacgtaaatcattgcatactttagataattttaccgcagtacgttttaacgcaccgtgtaccataacataagcaccacagtctgaagtggcttcaattaagtttggtgcaactgtacaaggtaaacctgaaacctcagataaacgcttaacaactaattctgaataaccttgaggagtatttaagccggtaccgatagctgttgcacccaaatttacttctaacagtaattcagccgtgcgggttaaattacgcacttcttcatctaataatacagaaaatgctttaaattcttgccccacagtcataggaactgcatcttgtaattgagtacgtcccatttttaagatattcgaaaactcttttgctttattttcaaaaccttgttgtaaataaagtactttagttaccagtttcataatactgttataaacagcaatgcggaaacctgtcggataagcatcatttgtagattggctggcattaacatgatccatcggatctaaaatatcatattcccctttcttatgacctaaaatttctaatgctaaattagcgaccacttcgttggtattcatatttacggaagtaccagcaccaccttgatatacatctgaaggaaattgatccatacatttaccatcaattaaaatcgcatcacaagctttcacaatcgcctgagcaattttatccggaattgcacccaattctccatttgcaagtgcggttgctttttttaccatgaccataccacgtacaaattcaggtacatcagaaatcgttacattagaaatgttaaaattttctaccgctcttaatgtatgaatgccccaatacgcatcagctggaacgtcacgttcaccaagcaaatcaatttcttttctcgttatcatatttctttcctttttaatttttcagactaaagaatgtaagtcattataggatagatagtcgtttaaaaatgtgatcccgatcacttttcagcactcctctcaccaatatattttttataaaattcattagttttttttatggaaaattaaataaaaaatacccttgaaagaaccaaaatatcccccatatagggtgagctttaattttttattaattattaataaggaacccaaacaatgaatattcgtccattacatgatcgtgtcatcattaaacgtgaagaagtagaaactcgctctgcgggtggtattgtcttaaccggctcagctgcaacaaaatccactcgagcaaaagtattagctgtgggtaaaggtcgtattttggaaaatggtacagttcaacctcttgatgtaaaaattggtgatactgtgattttcaatgatggatacggcgtaaaagcagaaaaaattgatggtgaagaagtgttaatcatttctgaaaatgatattttggcaatcgtagaataaaaacaaattaaattaataggaatacagaaaatgacagcaaaagacgtaaaatttggtaatgatgctcgtgtaaaaatgctagcaggtgtgaatgttttagcagatgcagtaaaagttactttaggacctaaaggtcgcaacgtaattttagacaaggctttcggtgcacctactattactaaagacggtgtgtctgtggctcgtgaaatcgaattggaagataaatttgaaaatatgggtgcacaaatggtgaaagaggttgcctctaaagcaaatgatgctgcaggcgatggtacaaccacagcaacagttttggctcaagcgattgtcagcgaaggtctaaaagcagtagctgccggaatgaatccgatggatttaaaacgtggaattgataaagcagttaatgcagtggttgaagagctaaaaattctttctaaaccttgtgaaacgtcaaaagaaattgaacaggttggtacaatttccgcaaacgccgatgaaactgtcggtaaacttattgctcaagcaatggaaaaagtcggtaaagagggggttattaccgttgaggacggttccggtctttcagatgaattggatgttgttgagggtatgcaatttgaccgcggttatttatcaccatacttcattaataaaccggaagccgcaactgttgaattagataatccgtttattcttcttgttgataaaaagatctctaatattcgtgaattattaccggtcctagaaggtgtagcgaaagctggtaaaccattgttaattatcgcagaagatgtggaaggcgaagcacttgcaacgttggttgttaacacgatgcgtggtattgttaaagttgctgcggttaaagccccrggatttggagatcgtcgtaaagcgatgttacaggatattgctatcttaactgcaggtactgtcatttcagaagaaatcggaatggagcttgaaaaagcaactcttgaagatttaggtcaagcaaaacgtgtggtgatcaacaaagataacacgactattattgacggtattggtgatgaagctcaaatcaaaggtcgagttgctcaaattcgtcaacaaattgaagaagcaacttccgattatgataaagaaaaactacaagagcgtgttgcaaaattagccggcggtgttgctgtcattaaggttggtgcggcaactgaagttgaaatgaaagagaaaaaagatcgtgttgatgatgcgttacatgcaacgcgtgcagctgttgaagaagggattgttgccggtggtggtgttgcattaatccgtgctgcaacaaaagttgcaacaacattaaaaggcgataacgaagatcaagatgtaggtatcaaacttgctttacgtgcaatggaagcaccacttcgtcaaatcgtaaccaatgcgggagaagaagcttctgtagttgcaagtgcggttaaaaatggtgaaggaaacttcggttataatgctggtacggagcagtatggtgatatgatcgcaatgggaattttagatccgacaaaagtaactcgttccgcactacaatttgctgcatctatcgcaggattaatggttacaactgaatgtatggtagccgatctgccgaaagaggagaaagctgatctgacaggcggaatgggtggtatgggtggaatgggcggtatgatgtagttctccccatattccatatccaatcattatgttaagaagggtcgtcagaccctttttatttttcaaaaaacgtagaccttaattattagctatctagaagtctagattgttattttgcctattttttattagaatactcaatattactaaggttattaaggatcaacgaaatggcagattgggacggaaaatatattagcccttatgcagaacatggtaaaaagagtgaacaagttaagaaaattaccgtttctattccaattaaagtattagaaattttaactaatgaacgcactcgtcgccaactccgtaatttacgtcatgcaacaaatagtgaattattgtgtgaggcgttcctgcatgcttttaccggtcaacctttgcccacagacgaagatctattaaaagaacgtcatgatgagattcctgaaagtgcaaaacaaattatgagagaattaggaataaatcccgatgactgggaatattaatagattaagtttggtaagttatttcagcaagtgcggtcgttttgaccgctttttcgctttttattagtgaatttcactcgggaatgttacaatccgctaccgttataacaatagagataaatacaatggctcgtacaaaaaaaactcgtcgaataacagatattatgcctatgcgtaaaacagataaacgtccggaaaatctgtcacgtcccggtaagaaacttactcgttatgaacttgatgctaaatctcgtgaagaaaaaaagaaaaaaaaacgtaaaggactaaccgctggttcacgtcatagtgcagtagatacaagtaaaacaatcgtacttaatgaaaaaaaagatcctcgtgttgggagtcgtaaaaaagttcctcttattgttgaatttgtgaataaacctgaaaaaggtatgtttattccttcaggtgctttagaggaaaaagcgaaaactattgatccgatgctggaactgacacaactcgaaaataatgaaagtttaaatcaattattagatgagcttgatgcaggtaaaaccttaagtaaaaaagatcaaatctttgtcaatcaatgcctagaccgtattgctcaacttatggctgaacttggaattgaagaagaaagtgaagatgatttgtaccgcacttttgagactattgatattaaccaatttaaataagctatgtggatcacaattttaatcattctcggcggattaattattagcgttatgcttggttacgcaatatatttattgctcgttttacaaaagcagaagaaagtttttttgcaagcaaaacaggctagactaaagcgtttaaaagaaagttgtgaaattatcgctaatgcaatgcaaagtggagaatgcaatttatctgaaggtgttatccgtctaaaaatgttgcttgaaccgttagggcattcattgaaaaattacacttcaatgtaccaactctatgaagcagtaatggatatgccgacccatgatgctcgacgaacattaaagaaaaatgaacgtatgcgtttagatttacaacgtgaacgtgctgaagctgatttagaacaaaacatcaaacttgaaattcagcgactgttaaattacctaaaagaatctaaggaaaaataaatgtcagaaattatctgggatttagcattaatccaaaagtataaccattcaggtccaagatatacctcctatccaaccgcacttgaattcaatgaaagctatactgataaagattttcagcaagctgctactcgttatcctacacgtccgctttctttatatgtacatattccattttgtcataaactttgttatttctgtgcttgtaacaaaactattactcgtcatcaacataaagtagagatttatcttgattatttagaaaaagaaattcaaacaagggctccgttatttcgtcatcgcatcgcaactcaaattcactggggaggcggtacaccgacttatctttcagaacaacaatctgcacgtttaatgcaaatgctgaaagagaattttactatttcagataaggcggaaatcagtatagaaatggatcctagagaaattgagctttctatgctggatcatttatacaaaattggttttaatcgtattagtatgggggtgcaagattttaataaagatgtgcaaaaagcagtgaatcgtgaacaagatgaagaatttgtgcgtgaattgttgattcgtgctcgtgagttaggttttcgctcaaccaatctcgatcttatttatgggttaccgttccaaaccgtagaaagttttatgtttaccctacataaagttatcgaactcaatccggatcgtttgagtgtatttaactatgctcacttaccaagccgtttcgccgggcaagcgaaaattaaggataaagacttaccaacacctgaaacaaaactaacaattttgcaaaaaactatcgaaacgttaggacaagcaaactatcgttttattggcatggatcattttgctaaaccggatgatgaattggcaattgcacaacaaaaaggaattctacaccgcaatttccaaggttataccacgcaagaagaatgtgatttattaggtttaggtgtttctgccattagtttattgggcgatacctatgctcaaaaccaaaaagatctcaagcaatactataccgacgtagaagaaactggtttagcattacacaaaggcttggtgatgacgcaagaagactgcctacgccgtgatgtgatcaaacaattaatttgcaattttaaattagattttcaaccgatagaacaacaataccaaattgatttcaaaacccattttgctgaagatttagctttgctccaacccttagcaactgacggcttagttgatattaatgacaatgcgttacaagtatctgctaaaggtcgtttgctcattagaaacatttgcttgtgttttgatacatactccagacaacaagcaaaaagacaacaattttctcgaattatttaacgaaaaagtgcggtcaaaattaaccgcacttttttaacctcgctgtgcatttttcataatgcgatctttcgttactttccattcacgatctttaatatcttcacgcttatcatgtaattttttcccttttgctaaacctattttcacctttgcccaaggacctttccaatataatgaaagtgcaacaatagtgaaaccatctcgatttgctttaccaaataatgaagccaactctttctggtttaataaaagtttacgtgttcttgtgggatcgcaaacaatatgcgttgaagcaacacttaacggctgaatggttgcaccaaataaatatgcctcgccatgcttaaaaataatataactatcgccaatactcgctttacctgcacgcatcgatttaacttcccagccctgcaaagaaagaccggcttcgatttcatcttcaataaaataatcgtgtcttgctcgtttatttaaggcaatcgtattagatgctacctttgcttttttctttgtcatataaattcatatctcattaaaaatttttcgcattttacccaatctaagcaaagatcgcaaaaaggcttgcattacatcgcattctctataacaatgcggatattcttgataacccgttacgcaaaatatgaaatataaaaatctacgagattttcttgaattattagagaaacaaggtgagctcaaaagaattacacaggaaatcgacccttatttagaaatgacagaaattgctgaccgcactttgcgtgccggtggtcccgcattactttttgaaaatccaaaaggctatgaaattcctgtgctttgtaatttatttggtactcctaaacgtgttgctcttggaatggggcaggaagatgttaccgcactgcgtgatgtagggagattactggcttttctaaaagaacctgaacaaccaaaaagttttaaagatttatggtcaactcttcctcaatttaaacaagtgctaaatatgccaacgaaagttttgagtaaagcagagtgtcagcaaattgtattctctgatgctgaagttgatttatataaattacctattatgcactgttggaaagatgatgttgcacctttagttacatggggattaaccatcactaaaggaccaagtaaaaaaagacaaaatttaggtatttatcgccaacaattaataggaaaaaataaactcattatgcgttggctatctcaccgtggcggtgcgttggattttcaagaatggaaagaagcacgccctaatcaaccctttcctatttcagttgctttaggggcagatcctgccactattctaggtgcggtcacaccagttccggataccttatcggaatatgcttttgccggattattacgtggtaataaaacggaagtggtaaaatcaatcagtaatgatcttgaaatacctgcaagtgcggagattattttggaaggttatattgatccaacggagaccgcacttgaaggtccatacggagatcatacgggttattacaatgaacaagaatattttcctgtatttaccgtgacacatcttaccatgcgtaaagatccgatttatcattcaacttacacaggtcgtccaccggatgagcctgcagttttgggtgaagcactgaacgaggtttttattcctattttgcaaaagcagtttccggaaattgtcgatttctatcttcctccggaaggatgctcttaccgtcttgcagttgttacaataaaaaaacaatatgcaggccacgctaagagagtcatgatgggagtatggtcatttttacgccagtttatgtacacaaaatttgtgattgtctgtgatgacgatataaatgcacgagattggaaagatgtgatttgggcaattacaacacgtagcgatcccgccagagattgtacaattatagaaaatacgcctattgattatcttgattttgcctcaccgattgctggtctcggctcaaaaatgggaatagatgcgacaaacaaatggattggagaaacgcaacgtgaatggggaaccccaattaaaaaagcccctaatgtagttaaacgcattgatgatatttgggagagtctaaatatttttgctcccaaataaacagcaaaaggtaaataagtgcggtgcttatttacctgtttatttcaaacgctcaaatccggctttaagatcggcaataaggtcatcaacgtcctctaaaccaatatgtaggcgaattaatgtaccggttaatttgcgttcaatattaggtctaatcctagcgatttcttccggttgagtgcataaaatcagcgattcaaatcccccccacgaatatgccatagtaaaaatcttaaaatgatccataaaattttctaacgcctgttgagaaagttttttatttagttcaaaagaaaataatccgctggaacctgtaaaatatcgcttaaaatattgatgccccggacaacttggtaatgccggatgataaacagtttttacttcaggctgttccagtaaccatttagctactttaattccattttcttgatgctgttttaagcgaactagtagagtacgaataccacgggctgtcatgtaggcggtatcagcatcgaccatctgccccattaaataagaattttcacgtaattgttcccaacaacgtgcattagccaccgctgtaccaatcatcgcatcagaatgcccaatgagatattttgtccctgcctgaattgaaatatcaacaccgaaatccaaagccttaaaaaatacacctgcactccaagtattatcgatcataactactattttaggattgatttggcgagcagcttgcacaatcgatacaatgtccggcatctccatagtaagtgaacttggtgcttccaaaaacaagactgtcgtatttggttgaactaaatccgcaattttttcaccaattaaaggatcataaaatgtggttgtaattgacattttctttaaaattatatgacaaaattcttgcgttggttcataagcagcaccgctcattaacacatgatcaccggtttttacaaaagctaaaatagcattacttaccgccgccgcaccgcaaggatagagatagcaaccctcaccaccttccaattcacacattaattcttgcaaagcaaaatgtgtcaatgttcctcgacgtccataaaataatccaccttttgctcgattgatagttgcttgttttttatctgctaaagtatcaaaaaccaatgaagatgcacgctgaataacagggtttaccgcatttttacatactcgtttattacgccctgcatgaattgttgatgtggtaaaagaagttgtattactcatagaaatatccattttaaacaaaaatcaagattataataattgatttaatagccaaaaactaatacaaaagtgcggtcttttttcataaaataattgtgcgaatttgctttagaatgcaaaattcttaataacttttataggagatttttactatggtattagttactcgtcaagccccagattttaccgcagcggcagttttaggcaatggtgaaattgttgaaaaatttaatctaaaacagcatattgctgggaaagcggcggttgtttttttctatccaatggactttacttttgtatgcccatctgaattaattgcatttgatcatcgttataaggaattccaagatcgtaatgtggaaattattggtgtttcaattgattctgaatttacacacaatgcatggcgtaacacaccggtagataacggcggtatcggtcaagtacaatatgctttagtggcagatattaagcacgaaatcgcaaaagcttatggcattgaacatcctgaggcaggtgttgcattacgtgcatcattcttaattgacaaagaaggtgttgttcgtcaccaagtcgtaaatgatcttccattaggtcgtaatattgatgaaatgttacgtatggttgatgccttacaattccatgaagagcatggtgaagtatgtccagcacaatgggaaaaaggcaaagaaggtatgaccggtagcccagaaggtgttgcaaaatacttgaaacaaaatgcagataaactttgatctcatcaattttaactaaaactagccccgcacttatgtggggctatttcattataaatctagtcattcttataagatcctctgaaaaataggaataacattattagcaataattttccatgaggatatacaaaaaagctcccaaaataaattttaggagcttcaatttttatttcataaataattagcgacgtaagcctaaacgtgcaattatttctgaatatttagcaagatctgtacgttttagatagtctaaaagtttacgacgacgagagaccatgcgtaataaaccacgacgaccgtgatgatcttttttatgtgtagaaaaatgagcttgcaaatggttaatttgtgcagtcaataatgcaatttgtacttctgaagaaccggtatctttcgcatcacgaccaaattcagcaacaatagctgcttttttttctgtacttagagacataaacattccttatactaaaagggttgataatacatcattcgccgatctctaactcagcgatgacaggaactgcagattttatctctcgattataaaaaaagcaataaataattactcaacatacaaactagacctacttacaatgttaccgcattatttatgcgtattatgcgtaaaaactaaaaatgaaggatatatttttcttgattttatagcaagaaagataaagaatattaactaataggattataattaattaagatatttaattttagataagtggcataagtggctaaaaatgttccacataaagtaggataaaaattttctcaatctattcaatcaaatttttggagatttatattatgacaatacaaccagatccaacttctgtaaaaacgcactttcaaggcaatgacaaactattgtttggtatgattatgggagtgattgccttttggctttttgcacaaaccacgttaaatattgcacccgatatggagcaagatttaggtgttaacaccagtattatgaatattgctgtatcaattacagctttattttcggggatgtttattgtcgttatgggggggcttgcagatcgtatcggctgtttaaaaattttaaatttaggttttttattgagtattattggggcattgttaattgcactggctccatctggtgatttagctgtcccactattaatgttagggcgtattattcaagggatatctgctgcttgcattatgccatctagtttagctttagtaaaagcctattgggagggtgaagctcgtcagcgtgctattagtatgtggtctatcggctcttggggtggttctggtttatgtgcactcttcggtgggttagtatctcaaaatctaggttggcgttatattttctttgcttgtgccgctttatctttattaggttatgttatgtgtcgtggtaccccagaattcaaaatggaagatgatggaaaaaaacataaatttgactggggaggtgttgttacctttatgattgccatgatcgctttacaagtattggtgactcaaggtggtgatttcggctggacaagcatgaccactatcggtttattgctagtgacttttgtgtcaatcgtattatttttatggattgaggagcgtgctgataaagcgtttgtggacttttcactttttaaaaatgcgacttacactggagcgactatttctaacttcttgctcaacggtgtagccggcatgttaattgtatcgttacaattagtacaattgggcggtaatatgactgcacaatctgccggattgctcactattggctatgcgattgcgattattgcttttattcgtgtgggggagaaattattacaacgttttggtgcccgtaaacctatgatttggggctgcctaattacaggcttttctattgctttgttattaccaacgaatatgatgttggatcaatataagattatcgttgttatttcttatatcttatttggtataggtttagcattttatgcaaccccatccactgatgccgcattatcaaatcttccgcctgaacaagcgggggcgggttccggtctctataaaatggcttcttcactgggtgcggcatttggtgttgctatttcagcggcaatcttcaccgcactccgtgcagagaatgccagtgtatcttggttaaataacatcgtcccttttgttggtcgccaagataatattgctattcgtgaagccgctattattgcattaatgtttaacttattgatgatttttggggctattgtgtctattatgttgactgtgccaacgggcaaaaaatcatcctaaccacagtatttacttgatattcaggctacctaaatcattccggtagtctgaaaccctaaaaaaccgggttcagtaaagaaaaaatcatgactatattatttacaatctatcaccccaagcaaatcggaaaaagcaacgtatattttcgttatatctaccagccactatatatttagtcaaaaaaatctacgtctaaatttattggcggtttcgtccaattttggggtatagatcattttgaccgttctttttattttttgcataatagccactttatttttatccgtctcttacgtatggagcattctatgctgacagaacaatctaaaaaacataccgcacttttgtcttttttacctgtattactcctaattgctattgatttctttaccatgagtttacaagctcaagcaaaagcaatttcccatttgagtttagctgtattagttacacaattattatgtattttagtgtttgccaaaggtgaaatttgcaatggtcagcgtttcagattagtaaaggtaaacttatattttttgatttattgggggttatggctgtttatcagtttattttccaattatcactatgtattaactgatattgtatgtttgtgtggcattgctttaactttggctatttggcaacaacctcaagatttgcaaatgcgtaagtcattgttggttttaggaacacttgtgggagttttaggtatagtaacttattgtttaatgtttattgatttacctttactttatttttctcaatataatccagtagctcaagcattgctaggcatcatattagcgaatttattgctagtcatcgctaaaaatcgtttacaaggctttattatcttattgccttttttgatgctgattactttattactgaatgcaattattgtgttaggtattttgttttttgctatatcacaacaagttgtattttctaatgagttttcttggggactttattttattttacatttacttgttactggcattattgctatacatttattttacaaatggaaatttgaatattacaccttgttaataatgagttttattgtaatgagttttcctttatgggtaagttttgcctatgtgttttaactaaaacaactgcctactttttggaaatgattgatcattgatgagtatgtatgttatcagataagagaaaagcggacaaaatgctttattttgtccgctttgtgtaatattgagaggactaaatgttaagtacagcaattaaagctaaaatagagtaaagtactgataatccgtagaaaataatcccacctgctggaatatgaagtttaaaatcatgtgtgccatggtgaattcgatgcattgccccccaagttggaaaaactaatacaactaatagaatcagtttacctaaccaagaaccggcaaaagcaataatattgtctgcaccgttttcgattaatccaaaaggtagtaatagacctaggataaaaatcaatatagggaagacaattgcacttactgtagtacctgcaccgaacaataaccatacaacaggttcgttagagcgttttggagtttctttcatcttggtctccctatttcaagtaaattagcactaaagcaagaatacttactacggctgtaacagcccacataccgatagtaataacattcggatttagtttttcatttttgtacacgatatttagcacttttggcgtcatgaagaaatacgtaactgtattcaaaatggctgctgccaaggcgataatattcagaataataacaattggattttgtaagaaaggaataaaatccgattgcaatccatctttttgacctaggcagatcacgccataaagtaataccaagctaaaccataatgatggaattgctgttgcttcacgcataatgtaaagtttgtaaaaatctagctttttccaccaagttgcttttacttcccgcacatatcttctgcgtttacttgttactgttgtcattttacactccttacttttgcggttttaacattgcaatgacgaaatcttttgcactttcgactttaccttggttgacaccagaagcaggatctacatgtttagggcagacttcggaacaataacccacaaaagtacaactccatacgccattcttaccgttaataattttcatccgttctgcttttccgtgatcacgattatcaagattataacggtgagcaagagttaagactgccggaccgacaaattcgggatttaagccaaattgcggacaagcggcgtaacataatccacagttaatacacatagagaattgacgatatttctctaattgagccggcgtttgtttagtacgactttccgccaattccgatgacgtatgtggtttaccatctaattcaggtgctttattgcctataatatatggtttgatactctccaaactttcaatgaagtgactaaggtcgaccactaaatcccgttcaatcgggaagtttgctaatggttcaatacgcatatgaccactataatcacgtaaaaaagttttgcaggcaagtttaggtttaccgttcaccatcattccgcaagaaccgcagattgccatacggcaagaccatcgataagaaagttccggttctaatttatccttaatataacctaaagcatctagtaaagatgtttgactgtcataaggaacttggtaagtacgtaagtatggctctttatccgcctcaggattataacgcaatacttcaatattcattattgcttgattagccatttgcttgctccttagcttttgcagccgcttcttgtgcttcagcttccgcaccgtaaacacgttttgctggttgagatttggtgattttcacatcgctgtattcaatccgtggggcaccatcagcattataatatgctaaagtgtgttttagataattcacatcatcacgctcagtatagtctaaacgttggtgagctccacgagattctttacgttcaatcgcagaattagcaatagattgagcaacatcgagaatataacctaattcaacggtatagagaacgttggtgttaaatacgcttgaacggtctgcaatacggatatgtttataacgctcttttaattctgcgattttatccacggtttgttgcatgctttcttgtgtacgataaatgccgcaaccttcttccattgaatcgcccatttcatcacgaatttgcgaccaagattctgttccttcttgattgtataactcttctaaacgatggataacatcttgagcttgagcatcgaccgcacttcggttagcaggttgtgcttcaattgcacgctgtgctgcatattcacctgcaacacgtcctagcaccactaattctgctaatgaatttgaacctaaacggtttgcaccatgtaaaccagaagacgcacattccccaacggcaaataaacctttaatacgggtttcgctattgaagtccacttcaataccacccatggtgtagtgtacgacaggacgaacgggaattggtgctttggcaggatcaacaccttcgtaagcattggctaattcacagataaacggtagtcgttcatgtaaatatttttcccctaaatggcgaagatcaaggtgaacaacatcaacaccttttgctgtttttaacgtattgcctttacgccattcttgccagaaggcttgggaaactttatcacgaggacccaattccatgtatttattttccggttttccgataggtgtttccggtccgagaccataatcttgtaaatagcgatagccatctttattcaccaaaataccgccttccccacggcaaccttcagtcattaagatacctgtattcggtaagcctgtcggatgatattgaacaaattccatatcacgtaacggcacaccatgacgatatgccatcgacaagccatctcccgtaacaatccccccgtttgtgttgaaacggaatgcacgacaaccgcctcccgttgcaataatgaccgcattagcattgatttgtactagagtaccttccatcatattcatcgcaaccataccacgagcatgaccgtcatcaactaaaatatctaatacgaaatgttcatcaaaacgctgaatttgtgggtactgaatggaagtttggaagagagtgtgtaacaaatggaaaccggttttatcagcagcaaaccaagtacgttcaattttcataccgccgaaacgacgaacgtttacatcaccatcaacttttctgctccaaggacagccccaacgttctaattgagtcatttctaccggagagtgttgaacaaaatattccaccacatcctgttcacacaaccagtctccaccggcaacagtgtcatggaagtgtttatcgtaagagtcctcatccttaattactgcagctgccccaccttctgctgcaacagtatggctacgcatcggatatacttttgaaactaaagcgatctttaaattaggatttgcttccgctgctgcaattgccgaacgtaaaccaccaccaccggcaccaacaattgcgatatcgacattaactgtttgcacgatattcctccaataatagataagagtaaaaattaatccctaacgggaaatcacaaaagcaatactattctgccactattttaaaagagatataactcttttttgttaatttaagctagaaaattttaatttcgtgatctaactcaaaactatatttgaaatagataagaaatattctcattaatttaaaattagatgataagcaatatcatttattaacaaaaacatagcgttactattagaaaaattgatttgtcgcattattatttttttcaggtagaatatttcaaaaaatttataaaggattttattatgtctttgaatgaacaatggcaacctagtgcctcgatccaaaatttattggcaagagcaaaaattattgcggatattcgtcgtttttttacagagcggggattgttggaagtggaaactcccgtattgagtgaatttggcgtaacagatgttcatctttcgactttcagcacagcctttacatctccgtttatggaaaagtcaaaaactttgtggctaacgacaagccctgaatatcatatgaaacgtttattggcagctggaagcggtgcaattttccaattgtgtaaagtatttcgcaatgaagaaagcggcaaaaagcataatccagaatttacaatgcttgagtggtatcgaccgcactttgatatgcatcgtttaattaatgaggttgatgatttgttacaacaaactcttgattgtgaaccggctgagatggcgagttatcaatttgtatttcaggaacatgtaggtatagatccattgtctgcaccgattaatgaattgattgaaaaagcaagagaatgccatttggacggtgctgaaaatgaggatcgcgatacgttgttacaatttttatttagcacgcttgtcgaacctaatattggtcaaaacaaacccattgtagtttatcattttccggcaactcaggcggcccttgcacaaattagttcagaagaccatcgtgttgcggaacggtttgagttttattataagggaattgaattggctaacggttttaatgaattgactgatgcacaagagcaagaacatcgctttaatcaagataatcgcttaagagaacaattggggttaccacaacatgagattgatcatcgttttttaggtgcattacaagcggggttgccaaatacagcaggggtggcattgggagttgacagactcattatgcttgctttaggtgctgaaaatatcagcgaggtgatttcgtttaatatagattgtgcttagaataaagtttttgtatcacattgcgaaaaagaatttttacaaataacggtaaattattctttcaaactaatttgatgtgaacccaaagattgtttacgattaatcattgcatgaactactaattgtgcagttttaatagcatgataaatttcaatactgtgaatctttttgagatcaataggacaatttttttccaaatgttgtagttgtgtaattaaacattgcaaattttttttagttctatacacattggcaaattgattcattaatgatcttacttgtcgcaatatttcacttgatgagtgagcggattttttctcttgattggctaaatgttgtaaatagcgtattccctttaacacataatgttctttattttgtgtagaaaagtgcggtacattttccacaactttttgtatcgctcttttggcaaacacgaggctaccgcctacagagttccctcctagacgatttgctccttcaatacatgcagaaacttccccaaccgcaaataacccctgtactgctgtttgggcgtattcattgatttcaattccaccgttgcaactatgagcaaaaggtcgaattattacctgatctcgcaataaatgaatatccatttctttttccagccaagttaaatagacttgataaaattccgttttatcatggtaaagttcgggagaataatgtagatacactcctttctcagtaggattttcaatcaaatgtttcattattacgagatcaaattcaacactttgaaaatccacactaaaaggtgcatagctactacgttgtcgtatcattttttgaaattgttgcggtgataaatgagaaaataaattcttacctttgctatcagtaacctttatcagatattttaaagtatgctcaccgaacaatactttatacttaggtttaacaaaagcaggaatgaattgaataaattcaagattggttaattttgcacctgcttgataagctacatagtgggtcgaacctattatatctgcaggatagagattgtcttgatacaaccctgcaataccgcctgtggctaatatgatattattcgtgtagcaaaaaatatagcgaatctcaccgcccttttgttgagcaaaaatagcacctttaatttgattttgttcagtaacaatatgtaataaaacagagttttcataaaattctatttggtgctgaattaaaatttgtttagcccgtttagcactttgtttccagttattaattaaatagatcgggcgagtatagtatgcaaagcaagcagggcggttatcttgtcgtagccaaggagtaaatccaattttactcaatagctcaatagcttgtggtgattcttccacataagccctaacaatcttaggattatttactccacaagcgactctctcaatttcttgttgaaagagaattttgtcatcggaatcccctgttatttgaataccaagtgtcgcttttagcggaaaaaaacttgcacctccacctattattgatttgctaattaaaatcggattaagtccttttgcttttgcctcaacacagcatgctaaccctgcaataccagctccaacaatcaataattccgtttcaatttggtggtgaaatttaatatttgtcataatctataaatcttttattaaagataaattcaatgcccacatcacaaaaatatcagcaatatcttctgcttaattaactactacaataatgatggtgctgcattgagtaaaattttggtatattcctgttgcggattattaaaaacgtccattgcatcaccttgttctacaatcaagcctccattcatcaccacaatacgatcagatacttgacgaacagtttgtaaatcatgagagataaacaccattgcgagatttaactcttttttaagatcggcaagtaaatttaacacttgagcccgtacagacacatcaagggcagaagtaggttcatccgctacgattaactttgggtttaatgccaatgcacgagcaatagcaactcgttgtttttgtccacccgacagtcgtgtaggttcaaccaatgctgcagagcgaggtaatcccactcggaaaagaagttcatacacccgtttttcacgttcatgggggtgcagtacattatggatattcattggatcttttaatatatctattactcgcattcttggattaagtgcggtggcaggatcttgaaaaatcactgaaacttgtcgtccgaattgtttgcgagcctctgcacttccgtatttcatctttaaaccgttaaattttactgtgccggaagagggtttttgtaaaccaatcataacattggcaagcgttgatttaccgcaacctgattgtcccactaaacccaaagtttctccggcctgaatatttaggctaataccatctatagcagtaaattttttcggattaaatattgaaccatcacgggaaggaaattgcaccacaatatcttgtaattcaatgattggttgtttttttaacactttcatactcatgttttaattctccaaatgcgatgcccataaatgtttcggattatcttctgcttgtactaatttcaaatgttgatttggatttgcattaggacgaagagaacgactggcaaatcgatctccttcagcaaaatcaaaaggcgatggtacactgccaggaatttgatacaagcgttccgctctacactcagtagaaagtactgaacccagcaaccctctagtatattcatgcattggattcattaataatgaacttgttggagcgacttctactacctgccctgcatacattactgtaatatgatgagcgatttgtgctactaaggctaaatcatggctaacaaaaaccatagcaaagcccaatttttctcgtaattcattaagtaatttaattacttctgcctgcactgttacatcaagtgcggtagtaggttcatcagcaatcaataatttcggttctctagccaatgccattgcaattaatactcgttgacgttgtccgcccgataattcgtggggatagcgatttaacgttttttcaggctctaatttaacccatcgtaaaagtgtttccgcactttgttttccgccacgctgaatcagttgtgccatttgatctttaattcgcattgatgggtttaacgcacttaaagcatcttgataaatcatagaaatttcgtgaccacgtaaatcatttaatttatctgttttcaataaatcatgttgatttcctgcacgatctgtaaaaagtatttctcccgtaatcttggctgttttaggcaataatcccataatggaaaatgcagaaattgatttaccacagcctgactcgcctaccagccccatagtttcaccttcatgaacagtaaaactaatattatccactagtggaatatcaccataacgatttggaaaacgaatagataaattctttacttgcaaaattggcttcattgctgaattaagttgcattctatcagtacgttccgattctttttgatttaattttaataaataacgtttaagtgctaaactttccgccatagcttcttgtacatcggtagcaagaggctttgatacatcacctttgttatttggattacgtttaagttttggattcacgagagcatcagttagtccttctgacaaaatattaagtgataaaacggtcaacaaaatcattaatccagcaaaggtagtggcccaccaaaagccacttaatactaaatttcgaccttcggataaaacatttccccaagatggataagggggttgtactccggctcctaagaaggaaagagaagcttccaatacaattgcatctgctaccatcactgtagcaaaaaccaaaacaggggcggcagtattgcgaactacatgctttaataaaatatagcttctactgccaccaattactcgctccgctctaatataatcttcttcccactgagaaactacattagctcgtacaacccttgctaactgtggcgtataaactaccgcgatagttaaaataataatcggaacagagttaccaaaagtagccaataataccgcagctaatgcaattcccggaaatgccattaaaatatccattagacgcatgatgacttcattaccaaatttactcgctgtagcagcggttgcacctagtatgctaccaaaaattattgcaaaacctaccgcacctaagccaataaacaatgatgttcttgcaccaaacactaaacgagagaaaatatctcgtcctagacgatctgtgccaaaccaatagtcactatttggtgcttgcaccggtcgtaaggtttgtaatggatcataaggagaaacccaaggtgcaaaaatagcaattaatgcaatcaacatgataaacattaaagcaattttagaggccattgataacgctttgaatcttgctccgccttgagcaagtctttcggctaatccttgacgaaacatcataaactccgaatttttggattgatcacaaggtacaatacatcaacgataatattgaccagtacaaaactaaaggcgattgttagtacaacaccttgtactaaatgcaaatcatgattgacgataccgttaaaaattaattttcccatacccggcaggtcaaaaatttgctcaataactaccgcacctcctagcaaataaccaattcttaaccccaatacagtaacgggggtaatcaacgcatttcgtaatacattatgacgaataacggttgcataaggaacgccattaccaatggctgttcgcacataatctttatccatttcttccaccatcgtagttcgtacaacccgaattagagatgcacacacaggtacagctaaagcgagtgaaggcaaaatcatcgaataaaaataaccgctcggatcttcactaaaagaagtaaatccgccggaaggtaaccaatccagttccagtgcaaaatattgaattaacaaaatcccaagccaaaaagaaggtgttgctacagccgctactgataataaacgaataatttgatcaatccatgtatctcgataaagtgcggcaataacgcctaaggtaaaagaaactattgcagcgaggaatacaccaataaaagttagctgtaaagttagtggaaaggctttcgcaatcaaagaagtaatcggttgttcaggtggtgtggtcataccgaaatttaagtgaattaaatttccgataaaacgaaaatattgcacaattacgggatcatttaaaccgtgctgttctcgataaagttgctttgcagcctcacttgcaccttcccctaatgcgacagtggcaggatcacccggtgtaaattgtaagataataaaaaccaaagcactcacacctaatatcattatgggtaatgccgctaaacgacgaagtaataagcgaaagacaatttccattatttttctccaactatacaaaccaagtcagtagaatgaatctgctatcaataaagataggggctgttaatcataaccacatataaatgaccgcactttctgctcattaaaaacaagcagaaagtgagaaaagttaattatttgcgacctacaccaataaatgaaagtccggtagttggaattggttggaaaccatccagtgatttgttattccaagcggttggtaatttacggtgcaaaattggataaagcggtacttgttcagcaataagattaatagcctgagtccaagccgcttttgcatctgatggctgttttgctttaattgcatcatcaagtaataattgcaatttcgcatattcaggggtatctgaccaaccgaagcgttttttcggccaaacatcaccacgataccaccagctcaataagagatccaaatcgttgctaaatactgatggatcccccggtgccattacgacttcataatttcctttgtctacgtaaccaccatacaatgctccagattgtagatgctgtaaagttactttcacacccggaattttattccaagattctaaaactaaaggggcacattcttttatccaagaatgatctgtagaaagcaattgaaattctaatttattcagacctgcttcttttaaaagtgcggtggctttttcaggattataatcatactgggttgaagccttgacataatcaggatgcgtatcttgagtgtaagaagtggcggcttttgcattacctaagaatacaatatcaattaatttttgtgtatccagtgcatagtgtaaagcttgacgtactttgggattgttaaatggggctttcttacaattaaacattaagaataacaatccgaaagattgcacggattcaaccgcacttttacgttttaagcgagatgcgtctaaataaggaacactttccattgcttgagtacgtccggactcttgtgccgctgtgcgagcggcatcatcggatagtaaaaaccatgtcattttttctacacgagcaggatatgggccgttgtaagcattgtgtgcggcaaatacgatgcgatcgtcttttacggctgaaacaaatttatatggtccggatcctaccggatttgcatcaaataccgtttgtcctacagcctcaatcacatgtttaggtacaatttttacaatacctaatcgcaatttaaaaagagaaaacgggtacttcaacttaaattctaccactttatcatctaaagcgttgactgaatcaataaacggaatgaattgtataaatagtgaagcattttttggatctaaaatacgctgataagaatatactatatcctccgtggtaacaggtgtaccatcgtggaaagtcgcaccgtcacgtaatgtaacacgccatgttatatcatcaacttgttcaggttcttttgcagctaaggcgagataaggttcacgggtggcagggtgtaaatccactaatccttcaaaaaagtgcatgttggcagcaaaggaagaggctccactggaagtggacggatcaaaaccggttgataggggataagctattcctgcttcaatgctactacctgttgttgaagtggctttcgccttagaaacaaaactacctaatgtaccgctaaaggcaattcctgcaccgacaccagccaatactttcatgaaattacggcgagattcattttcaatgtaatttgtcatacatgctccttaaaagtctattttgcacacacttattgagattaatacaacgttccttacacttacacagaatattattccctaaaatgaagtaaattaatcacaatataaattaaaatgaattggattaatcataatcgtttagagcaaacagtcaagaatatatgtaaagtaaaatctatgtttgtgaactaggtcacgaaataacggaaatctcaatttgattaaagagctaactactatctaaaagcccctgtcagctatagggaaacttgatgaatataaagtggctaattagccactttgtatttgcatttgatatttaaacagatgttttaaagatgacattattcgctttctgaatatagctattcatttgatcaaaattcatatagcgataggtatcgtctttatcttgttgcaaattttgaacaaaatctaaatattcagatggagtaggtaatttacctaacaatgcagaaacggctgataattctgccgaggcgagatacacatttgctccttgtcctaaacgatttgggaagtttctagttgatgttgaaactaccgtcgcaccatcggcaacacgagcttggtttcccatacaaagagaacaacccggtacttcaattcttaccccacttttaccataaatgctgtaataaccttcgtcactaagcaacttagcatccattttagtagggggagcaagccatagtcttgttggaattgtaccgttaaagcgagctaataatttacctgctgcacggaaatgaccaatattcgtcatgcaagaaccgatgaacacttcatcaattttgtcgccctgaacttcagaaagtaaacgagcatcatcaggatcattcggggcacataaaataggctccttgatttcattgagatcaatttcaataaccgccgcatattcggcatctttatccgcctctaatagttgaggattcattaaccaattttccattgctcgaatacggcgttcaagggtacggacgtcaccatagccttcggcaatcatatatttaagtagaacaatattagattgtaaatattcgataataggttctttagcaagtttaatcgtacaagcagctgcggagcgttcagcagaggcatcggacagttcaaatgcttgctctacctttaattgctccaagccttcgatttctaaaatacggcctgaaaaaatgttctttttacctttcttttctacggtaagcaatccttgtttaatcgcataataaggaatggcatgaaccaagtctcgtaatgtaatccctgcttgcatttcacctttaaaacgcactaaaacactttcaggcatatctaaaggcattacccctgtggctgctgcaaaagcgaccagtccggaacctgccgggaaagagataccgattggaaaacgggtatgagaatctccgccggttcctactgtgtcaggtaataacatacgatttaaccatgaatgaataacaccatcgccaggacgtaaagatacgcctcctcgattcataataaaatcgggtaaggtatgatgagtaaccacatcaacaggttttggataggcggcagtatgacagaaagattgcatcactaaatcagccgaaaaacctaaacaagccaaatctttaagctcatctcgggtcataggtcctgtagtatcctgtgagccaacggaagtcattcgaggttcacaatattgtccgggacgaataccctctacaccgcaagctcgccccaccattttttgtgccaaagtgaaacctttttgattttgcaccgcactttgtggtttggcaaaaacatcgctttcaggcaatcctaatgcaactcttgctttgtgagttaagcctcgcccgataatcaatggaatacgtccaccggcacgaacttcgtctaataacacattagtttttaagctaaattcagctaaaatatcattactgtcatgacgacaaattttgccttcataaggataaacatcgatgacatcgcccatatttaaacggctgacatctacttcaattggcaatgatccggcatcttctagcgtattaaagaaaataggtgcaatttttccccctaacaccacaccgccggcacgtttattcggaatataaggaatatcttcccccataaaccataaaactgagttagtcgcagatttacgtgaagacccagttcccacaacatcgcctacataaaccaacggaaagcctttttgtttcagtgtttctaattgtttgattggaccaatattaccattatcatccggtttaataccttctcgggcattttttaacatagcaagagcatgtaatggaatatcaggacgagaccaagcgtcttgtgctggcgaaagatcatcagtattagtttcaccgctcaccttaaatacggttaaggttaatttttctgcaagttgagggcgagataaaaaccattcagcattagcccaagattgcaaaatctgttgtgcaaaaacgttaccgttttctgctcgttgtgcgacatcatgaaaattatcaaacatcagcaaagtagaagacaacgctttcactgctataggtgctaattcaggattatcaagtgcggtcaataatggctcaatattgtaaccaccttgcatagttcccaaaatttctactgctttgcttggtgaaattaatttacaagttaccgcactttgtgccagtgcggctaaaaaaccggctttaacataagcagcttcatcaacaccggcaggaatacgattctcaaataaatcaagtaggaaatcctcttttcctgtcgggggatttttcaataattcaattaattgagctgtttgctctgcatctaaaggtttagggacgacgccttgtttagctcgttcatcgacatgtttttggtaagtttgtaggaaatcgcacattattcactccattaagattgttgagtagagaaaagagaaagtgcggtcatttttgttaaaaaattgtaatacaaatagaccgaattcatcataatacggaatttatagatgaacaatagaaaaaagacgattattaaaaaataaccgccttttttaaagtagaacacaaaatgtttaaaagacttttttaaatggtttaatgatgactttatcatatacaccggctgcaacataaggatctgtatttgcccattgctccgcttcttctaagctattgaattttgcaataacagttgaaccggtaaaacctgcttctccaggattttcatcatctatagcaggattaggtcccgcagttaataacctatcttcagcttgtaattgttttaaacgttcaaggtgttgttctctgacggataagcgtaatgctaatgtatcaggtttatcttgagcaaaaataacatagtacatcatggtttatttctcctatttattatgagttatttgctgaaatttgtgccaatgctttttctacttccggattattgtctcttggtatggctcgaggtttaccttgtgcatctacggcaacaaaagtgaaaacagcttccgttacacaatagcgttcaccaataggttcgctggcaacctttttgacccatacttcaattttgatttgaacggaagagcggccaatttttacacattccccataacagcaaaccacatcgccgacagcaataggtttgataaatgtcatactgtttacagctactgttacaacacgtccatgagcaatttctttagctaaaatggcacctcctatatccatttttgacataatccaaccgccgaaaatatcgccattcgcattcgtatttgaaggcatagctaaggtacgtaataagagaactcccttcgattgacgacctgtattagtttcaataaatactgacatagattttccttattcttgttctgatttaggtaaataacgataaatataaacaccggttactaatgttgcaatcagtgtcatgccgagaatgccgaaggttttaaaatccacccagatgtcatcagaaagatactggcttatgtaaagattaatcagcatacaaagtaagaaaaagactgcccaacctaaattgaggttatgccaaacataagtgggaagctgaatttctttgcctaataattgttggattaaaggttttttaaaaccatattggctgacaagcaaaatcaaggaaaaaagggcataaacaacggtaaccttccattttaaaaattccaattcattaaaataggcacttagagaaccgaaaaaaactaccgcacttcccataataagttgctgtttctcaatttttccatatttaagttttaaaatcatgagttgaattaacgttgcaataatcagcgtaatggcagcagcttgaataccttgtaatttgtaaacagcaaagaataagatcaatgggataaattctaatagttgtttcattattgtcccctttgttgcataaagagagtgtaaaaacggtaagtgaaaattaatagaaatacgtctgcaagggaaattattgcagtgattaagatttccataaacagattatgactgagaaatagcgaaagctgtcttaataacaaaggcaataggcaattgattaaagtatataagaataacaggtgtgtgcgttttactccgcttttccacattgtttttaaactttgactaatggagtgattatgtatgaggtaatggacattgagtaaattaagacgcacaaacacaaatatacctaatgcgagtgcaaataaagaaaagatagaaggtgatttgtgcatgagagctgaaactagaatttcacttgtaccgatacccaaaggaatagctattaatatattgagtaacaaaagccctccgaaacgtttagttgtcgatataacgctttgagatagttgcggttcgatatgttgactgagttggtgaatggttaatattccccaagcagaaataaacattctcaataaacccgatatgaacaggtaatgactgagttgcaaagtttccgtatttgatattgtttctgatagctcaagcgtgtctgtttgtattgactgtttaaaaaataaagcaaatacagaaacaataaataaaagagcggtaaattgtagcgtgattttttgttgattgcgtacaaagttccaacaatcttgaaatatatgagtaaaattaatcattcaaaaatccataaataaaagcaaacgttacgcattatactgtgtttacagccgaaagtataaaaatccttattacagaccttaagcatactaaagaggagatttaaacttttagtaagctgattgtaacgattttaaaaaaatttttaacaaaattttataaatttgatctagttcacggaaataatacctcttaagtggtattgtacccgctgattgcataaatcggcaatttttattgtgagcaaatattctaatagatgaggaattttctatgaaaaaaacagcattagtacttagcgtggcggctgcattggtggcaggaagtgcaacagcacatgaagcaggcagttttattgttcggggtggtcctattttagttgtgccgaaaacatcaacaaatgatactacgtttaagtttgatgtaaacaaaaatgcccaattggggttgaccggaacctatatgatgacagataacttcggggttgagttattagccgcaacaccgtttcatcataaaatcacgttagaattacattaggtagtgccttagtaggtaaaacaaaacatttaccgccaagcctatatttacaatattatttcttaaacaaagattctaaagcacgtccttatattggtgccggtgtgaactatactaaattctttggtgaaaaagcgataatggagggtgtttccaatcttaaattaaaagattcttggggagcagtatttaacgcaagggtagatattcaattgtccgataatctttatttaaataccgctgtttggtatgcgaaaattaaaacaaaagcaagttttaaaatgaatggtgctgtycaacaacctcaacagaataaagtcgatgtaacccttgacccaatggtatttttcatcggtttaggttggaaattctaagcagagaaaaatattgttgaaggcatgaccaaaaggtgatgcctttatttttttctcaaaatgaccgcacttttatggaaatagcgtataaagtaaaaattaatgttttctctttacatgattttcgttaaaattcggcattcgtccatttttagttattacaacaataatgatcaagcaagctcaattttatattctttctcaacaacaaggaaaaaacggactttttgcggaagaaagtcttacttgcgatcttgccgcctccgcttggcggttggggaaaaaagtattaattacttgtgaaacggaagagcaggcattaaaacttgatgaagctttatggcaaagagatcctgatgaatttgtaccgcataatttatccggtgaaatgacttcatacgtaacgccgatagagatttcttggcaagggaaacgtaatacacaacgacgggatatactgattaatctgcaatctcaattacctgattttattatgagttttaatcagctaattgattttgtgccggttgatgagcagttaaaaattcttgcgagagaacgctataaatcgcttcgttcgcaaggttggcaattacaaacagaaaatatgtaaatttttataaggagtttttttatgaaatctaaaattttggctaccacactcgttggattgctattcggattggttgcttgtgaaaaatcacaagaaagcgtatcaaccgaaaaactggataacaagcagacggagcaagttgaacaaaaacaactggaaagtgcggtggaaaacagcactgaaacacctgtgcaacatgttcaaactgataagatgtcagaaggaatgaaatcaacaaccgaagaagctagcactgattcagcaataaaccaagaaaaattagctgaaaataaagctaaacaggttgaagctaaaaaagtagcggaaaaaaatgaaaccaaaaaagttattgcgattttagaaaaacaataccaaagccttcattgcaccgatggaaataaaagcgaattttgtgtagaagaagcacaacgcttaaaaagtgaaattgaacgactaaaatctcaattgcgtaaatagaaagatgagtagtcgttagatttaagacatctacgctagataatctcttctctctaggcggtaagttagaaaaataacaagccgtagaatggctaatttatgcccagcttcacacggtttctatggggaaagagcggttagatttaagaaaaattttgcaaaaatgaatcataaattagtccaaatcgatcagctaaaaaatcagcttacacaatatcgtccgctttctgaatcagaagtacaacgcttgcgagaagagtttattattgaaagctcatataattccaatgcgattgaaggcaataccattaccctgcgtgaaacagtgctgattttaaaagagggaatgacgattgcggaaaagccattacgagaacatttggatattatcggttttaaagatgcttttaactatatttatgaattggtagcccataatgaaccgttaagcgagcgaaccattaaagatattcattcgcttgttttaatgaataatgctgaaggtcgaggggtttatcgtaaaattccggtgcgaattttaggggcagaaaatgaaccgacagccccttatttaattgctgaagaaatgcagtcattgattgaaaaatatcaacaaaaactgaccgcacttcaccccatagaagcaattagttggttgcatttagcctttgaaagtattcacccgtttattgacggcaacggacgcacagggcgattactgattaattttgaattattaaaacacggctatttgcctgttgatattaaatttactcatcgagcaaactattaccaatgttttgatgatttccataaaaatcagcaagatataagtcgtttggttgagttgattagtcagtatgaagtggctgagttgaacaggtatttggcgattttggaacagaggacataaaatgacaagccgtgaagaattactcaaaaaacaacgagagctagatattctttttaccgcgtggtttgaagaaaagaaaaggcacgaagtgctgacttatcgtcgtgaaaatggggatttgattcagcattatccggacggtacagagaaagtgatcaaatatgctgaaaaaactagcactgctcgtatggcgtaacaagcggttggatttaggcaaaattttgcaatgctttaatcggagggaattgtgatgactaaaccggtaaatgcggaatatatcaaagaaattattgataaaacgaataatcttggctatttggacatccaaggaaaaaccttgcaagaaaaacaagagagttttaaatctttaattcaggaaaaattaaagggatatcacaatgacagtcgaaaagatcattatcaccgaagctaaggttcacgagctttttgttgaaatcagtcaagaattggggtttagtgatgaagatattttacatcattctcaaaacattcttgaattgattgaaatgtggtcagagcaaaaatttgtcgaaatttatcaagaaaatacggatagagtttttggtcgggcaaaagatagtagtcttgcaccaggtgcggttccctattatttaggtatttatcacgccagagtagataaacaaggtgaaaatgatccgttaatcgttttaacatttagatcagaaagagaagataacatcgctgaaattcgctttatggcaacacacgatattttatttggcactgtttccgataaattatttatgcaacgaatgaaagctattcgtcaaagaattgatcttttagtccaaaaagggaattaatttataagggctacacggctacgcatcagcccacacggctcgtgtggggtgacaagcggttaggtttaagaaaaattttgcaaaaaacttctcaaaacagaccgcttgtaaaataacaaggcatttgtctagagaggagtaccatctggaaaataatcaaatatgcagataaaaaataacttaaagtttatggacttctgctcaggtattggcggaggtcgtttagggctagaactaaacggaatggaatgtattgctcacagtgaacttgatcctaaccctgatttaacttatcagctcttttttaatgataaaaataattatggggatttaaccaaaataaatatcaacgatttacctgaatttgatgtaatgcttgcaggtttcccttgccaaactttttcaattgtaggaaaacgcaagggttttgaagatgagcgtgggcagattatttatagcttggtcgatattttagctcttaaacaaattccttattttattttggaaaatgtaaaagggttggttaatcataataaaggagaaaccataaactctattgttaagctgctagaagaaacgggctatgatgtttattatcaggtattagatagtcaattttatggtgtaccacaaatgcgtgagagggtttattttgtgggtattagaaaagatattaaacacaaaccttatcaatttcctgaaatggaagatgccaaacctatttcttattatttaagtgatgaccgtgattatacctttgatgagaaaaatgaaactttccagaagtatttgaataataaatataatcaagggcaaaataaccttactgaaattttgcaaacggattataacgtgattgattggcggcaatctgatttccgactttatcctgaaaaaagcccgacattgagaaccggacgacacggtattttatataccaaaaatggtaaattgagaaaattaagtggttatgaagcattactattacagggatttccaaaagaaattgcacaaaaagttatcgagcataaattacctgacagtaaagttttatcccaagctggaaatgcaatgacggtgacggttattcagaaattagcggctcaattattaaaatcgatagaaagcatatagagaggtgaagatggatttagccaacctaggctcacaaactgcaaaaaatggctttaagaatgaaaaagatattgctgatcgttttaatcattggcaatcacattctgaagctcaagactggttaagaataatgggttatgaattagataaaattgaaaaggttaaagctgttgtattaagtggttataaagcagatattaatgttcaagtatttatcttttttaaagaagctgttgatgttcgtaacattcaagtaaaattagttagtaataaacgaggctttagtcaaatagataaacgctggttaaaaaattatcatgagatgtggcaattcccagcagaaatttaccgcttgttacagcatttttgtggagaactacccccggttattgagaacccaaaagataagcgaagaatgtttatcacagaatttagtgaacaagaacaacgtttaattttagattggttcaagcagagtaaaattttagttttaaccgatattattcgtggtcgaggagatttttcagcagaatgggtattagttgcccaaaaaattaacgataacgctcgttggattttgaaaaatattaatgaggttctacaacattatggtagtggcgaaattaagatttctcgacaaggttcaattaaatttggtcgggttactattcaacgtaaaggtggagatcgtggcagacaaacagccaatatgttgcaatttaaaatagatccaaccgaattatttgagatttgatttcaagctgcccccaaatgcaaaaattaacataagagaaaaaccaatgacaaaacaattcacaatggaagaccgttttaacccttccgccgtagagcaagcactctaccaacactgggaatcgcaaggctattttaagccaagcgaagatgttaatgcaccaagctactgtattgcgattccgccgccgaatgtgaccggttcgctacatatggggcacgctttccagcaaaccttgatggatactttaatccgcttcaaccgtatggagggcaacaacaccctttggcaaacgggaacagatcatgcaggtattgcgactcaaatggtggtggagcgtaaaattgctgcagaagagggcaaaacccgtcacgattatgggcgtgaagcctttatcaacaaaatctgggattggaaagcctattcgggcggtacgatcagccagcaaatgcgtcgcttaggcaactcgattgactgggatcgtgagcgttttacgatggacgaaggtttgtctaatgcggtgaaagaagtatttgttcgcttacacgaagaaggcttgatttaccgtggtaaacgcttggtgaattgggatccgaaactgcacactgccatttctgatcttgaagtcgaaaacaaagagagcaaaggctcgctttggcatttccgctatccgcttgccaacggtgcgaaaaccgctgagggcttagattatttagtggtggcgaccactcgtcctgaaacaatgttgggcgatacagcggttgcggttcaccctgaagatgagcgttatcaatcgctgattggcaaaacggtcgtgctaccgcttgccaaccgtgaaattccgattattgccgatgaatatgtggatcgtgaattcggtacaggcgtggtaaaaattacccctgcacatgactttaacgactacgaagtgggcaaacgtcacggattgccgatggtaaatgtgatgacgctcaatgccgatattcgtgcggaagcagaaattatcggcacagacggaaaaactctcgaaaattacaccgcacttattccacaggactatcaaggcttagagcgttttgcagcacgtaagaaaattgtggctgattttgaggctctcggcttattagaccaaatcaaaccgcacgacttaaaagtcccttacggtgaccgtggtggcgtgccgattgagccgatgctgaccgatcaatggtatgtgagcgtgaaaccgcttgccgaagtcgccaccaaagcggtggaaaacggcgaaatccaattcgtacctaaacagtatgaaaatctttacttctcttggatgcgtgatattcaagattggtgtatttctcgtcaactttggtggggacatcgtattccggcttggtatgacgagcaaggcaatgtctatgttgctcgagatgaagcggaagtgcggtcaaaatacagcttaactgcagacgtagcgttaaaacaggatgaagacgtattagacacttggttctcgtccggattatggacattctcaacacttggctggcctgagcaaaccaaagaactgaaaatgtttcacccgaccgatgtattaatcaccggttttgacatcatcttcttttgggtagcaagaatgattatgttcacgatgcacttcatcaaagatgaaaacggcaaaccgcaagtgccgttcaaaactgtgtatgtaacgggcttaatccgtgatgaacaagggcaaaaaatgtcgaaatcaaaagggaacgtgttagacccgattgatatgattgatggtatcagtcttgaggatttgcttgaaaaacgcaccggcaatatgatgcaaccgcaacttgccgagaaaattgccaaagccactcgtaaagaatttgaacatggcatttctgcacatggaacggatgcgttacgctttacccttgcggcgttagcgagcaatggacgtgatatcaattgggatatgaaacgtttggagggctaccgcaatttctgtaataaattatggaatgctagtcgttatgtattaacccacgaaaaattggatttaagtgagggcgaagcggaatattcgttggcggatcgttggattgagagtcaattcaaccgcactatagacgcatttcgcaccgcacttaagcaataccgtttcgatttagtggcaaatacgatttacgattttacttggaatcagttctgcgattggtatttagagctaaccaagcctgtatttgctcatggtacggatgctcaaaaacgtggtacaagtcgcatgcttctcaatatattagagaaattattgcgtttagcacatccaattattccatttatcacggaagaaatttggcagaaattgaagggtgtaatgaagttatcaggcgataccattatgttacaaccatttccacacatagaggaaaatcggcttgatctagaagcggaaagccaaatgaattggttaaaagaagtgattgtagcggtgcgtaatattcgtgcggaatgcaatatttcaccgagtcatgcgttggaactgttgctgagaaacatttcagaggaaacaaaaatttgccttgaaaataaccgcactttattacaatctatggcaaaattgtctacgattactttactggacgtcaatgaagaaccgccactttcggtcacgaaactggttgaaaataatgaaatttttattccaatggcaggttttattaataaagagcaagaactcacaagattgactaaagaaattgaaaaattgaaaggtgaaattgttcgaattgaaaacaaactcagcaatgaagcctttattaccaaagcaccggagcaagttatcgccaaagagcgggaaaaaatgcaggggtattcggataatatagaaaaacttcaacaacaatatcaggcgattgagacgttgtaagtatttaggtcgatatttgatctcccgccgtcaaatggcggtcgggagatcgatgttaatcgtggtgaaaatctatcttaggttctcccaagaataacggaccgagtggatttttaggcaaattgaagtgattaggatacttcacctctaccaaatataaaccatcaggtttagcagttggtgcggctaaagtgcggtctttttgagttaaaagccaatccatccattcaaccggctgttttccgcttccaatttctaaaagactgccaacaatattgcgtaccatatgatgcacaaaagcgttagcctgaatatccacaataatgtaattggcttggcgaaaaacatggagatgatgaatatttcgccatggtgtattagactggcattgtgcggcacgaaatgaagaaaaatcatgttcccccaataaatattgccctgcttggtgcattaaacgatgatccaatgcaacgtgatgatgagtaactccagtgggaaaaagagcggaacgtagcggatgattataaattaaataacgataacgccttgctgtggcactgaaacgagcatgaaaatcctcactgacgacctttgcccaacgtaccgcaatatcagcaggtaaattggcattaagaccgaatgtccatgctttttcagagcgaatcgctttcgtgtcaaaatgtaccacttgaccggtagcatgaacacccgaatccgttctacccgcacaatatatttgacaaaattcatttgcaacaaaactgaccgcactttccagtttttcctgtacacttgtgacattcgcttgacgttgccaaccgaaataatgtgtaccgttatattcaatacctaatgctattttcatattatgttatctgttaagctgaaacccattttatgatacttgaatatagtcgagcggtatatcacctaaatacgccaatagttcttctgtcataccacgatatgacaacctgaaaggttgttcaaccaataccgctcgagcaatattttccacttcatttccatttaaaagtaaataattcaatgctgtttgtagtggcggtaaagagggattaaatgcggcattttcagcataactgccttgaaaaatctgttgatcttgcaattgcaatgcaatacctgaataggttttggaataaggggcatgagattgattagcagcatcaagtgcggcttgaattaacggatcttccgttatcaaaaataaattatgtgcttttttatcaaatagacgattatctatctgtaaattatggggtccaaaagcatccggcaaatagtgatgtaataaattatcctgactatgtggcaaatgaatgcgtaatgtttccgcactgttaagttcattcataaattggcgacaatgtccacaaggtgtgtaattgacggtaatctccgttattttactttcacgacgcatccaagcatgagaaattgcactttgctccgcatgaacggtttgctgaatgttcgtggtacaaaattcttgattagcaccaaaataaaagttgcctgactctcctttagcaattgcccccacactgaaatgggagattgtgggattagcataacacgcactgacgggtagtaatattaaagccaattctttgtccgtcatatgatatttttcgcaaaaatggtttactgtgaatgcgggtagaaagccctgaaaattctgttcgcctaagatataccacagatcctgagccaaatttctgttttcaatttgatttaaagcctgtttaatccgatcagatatatgttttaatggatgatgtgtcatcataaatccttgttgaatattgagattgggttgaatgtgccaaacatttaaaataacgtcaagtagatgttttaattgtatcttattatttttggctgaaaaatttctaattataacaagttaaacacttttaatatttcatcaaaaatataattttctgcattgaaatagttactcttttttaaacgacatagcataactcgccataaaattggatctttaatttttacgctgactaaatgaggatcgggataatagtacgctgtagataggggtagaatagtcaaaatatctgaattagattttgcagtgtaatataaaaaatcccaacaggctgattcatagatgatattagggtaaatattatgtcgttcaaatgcttctttcaactgttgataaatcataaacgttttatcaaagatgacaattttctctttatgtaattcctgccaagtcacactttctttttgagcaaaatgatgttccggagagcaaaataccgagagttctgagcgataaatttcgaaagattcaataatcttagatgaaatatgttcaggatagagcaaggttgcaaaattgacattacctagtaatagttcaccttttaatgaatatgcaccttgttcttttacttcaaattcaatttgaggattatttataatcagttccggcaaaattttagaaaaaatcaaagataaaattaaaggtggaataccgatagatattcgccctgtcatttcttgttctttcttatgtagatttttgttcatttgattgtatttcttgagtaattctttagcatcacggtagtagttttctccaacgtaagttaaccctctaatttttccattagctcgtgtaaataatgcaatattttcttgatgctcaaattcattaatcatcatacttaatgccggttgagaaatataaagattttgagatgtccgacttaaattgaagccgttttctacaattccaataaaataacgtaaatgtttgatatccatgatttctccttaaccaattttgtgttcagccgttctataagctgtgtttcttttgtattctttatatgtatctacattctataagattaatttataggtatgtaaaaaaactgtattttgaattattcgaacaaattactacacttacctcaaataaggtaagaatactagattatctagattttataagtatgcttgcttagtttttttgggatgtattgagcgttttactctctcaatgtataacaaaaatttaaccttaaatataaatttattttatctcataggaagatgctatgtctaaatttatttcaattgatgagctcaaatctcatttttttgatggaatgacaatgatgtccggtggtttcatggggtgcggtgctcccgaactgatcattaaagaaatcttagaggcaaacattaaggacattactctaatcagtactgacaccgcaatggtagatactggggtaggtcctttaattgttaatgggagaataaaaaaactatatgcctcacatatcggaacaaattctgaaactggtaagaaaatgatttccggtgaattaaatgttgaactttgtccacaaggtactttagcagagcgtattcgtgcaggcggagcaggattaggcggatttttaacgccgacaggggttggcacagtagtagaaaaaggtaaacagaaaatcactattgatggtgtggaatatttactggaactaccgttaaaagcagatattgcaattattaaagcggatattgccgatgagattggtaacttagtttttttaggtgcagctcgtaattttaatccaatcatggctctcgctgccaacacagtcattgtacaagcaacaaaaatcgtgaaagtaggtgaaatggatccaaatttagtgatgacccccgcagcagtggttgattatattgtaaaagcgtaacggaaggagaaaaaacaatgaatgctaaagaaattattgctcgccgtattgccttagaattaaaagatggtgatgttgttaatcttggtattggtttgccaactatggtagcaaattatatcccaagtgatatttcaatcactctacagtctgaaaatggctttttaggtttgaccgcttttgatcctgaaaatcccgatgaaaatattgtgaatgccggtggtcaactttgctcaatccaagcaggaggtatgttctttgatagtgcttattcatttgctttgattcgtggcggtcacgttgatgcttgtgtactgggcggtttagaggtcgatcaagaggcaaacctagcaaactggatggtgccgggaaaaatggtacctggtatgggaggcgctatggatctagttactggtgctcgtagagtaattataggtatggagcattgtgcaaagacgggaacctcaaaaatactaaaaaaatgcactttgccactaaccgcacgtaataaagttcatctagtcgtgactgagcttgccgtatttgaatttatcaatggacaattaaccttaactgaaatggcggaaggttatgatttggatatgattaaagctaaaactgaagctgaatttgtcgtttcgccaaatctaaaaacaatgtcgttggcaggtgcataaggagcttattatgattagccgtatttctcggtttatgacaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaaaataaggaagcaactatgaaaaatgtcgttattgccagtgcggtgcgtaccgcaattggaaattttggcggttcacttgcagacacctctgctgtggaactcggtacagctgtaatcaaatctgcgattgaacgagcaggtattgatataactgctattgatgaagtaattatgggaaatgttttacaggcaggtcttggacaaaatcctgctcgtcaggcactattatgttccggcattgctcaagatgtaccagcttatactgtcaataaagtctgcggttcaggcttaaaagcagtagttctaggcactcaagcaattaaagctggtgatgctaaggttatcatcgcaggtggtatggaaaacatgagccaagcaccttatcttcttgaatccaaatctcgttggggctaccgattaggagatgcaaaagtacaagatgtgattttatctgatggtttgatttgtgctacaaaccactatcatatgggtatcacggctgaaaatatcgctaaaaaatatgatattacccgccaaatgcaagatgaattagcacttgcctctcaacaaaaagccaccgctgcgattcaatccggtgcattcaaaaatgaaattgtaccgttaaatatcaaaattaaacgcaaagaggtcattttcgacactgatgaatttgtcaaacaagattcaaccgctgaaggtttagcaaggcttcgtgccgcatttgataaagagggtagtgtaactgccggtaatgcgtcaggtattaacgatggtgcggcggcattagttattgttgaagaagaaacggcaaaagcattagggttgaatattcttgctcgtatcaaaggttatgcaagtggtggcgtatcaccagatattatgggaataggacctgttcctgctactttaaatgctttgaaaaaaacaggtttgcagttaagcgatatagacttaatcgaagctaatgaagcttttgcggcacaatttttagctgtaggtaaagagttagggtttaatcccgaaaaagttaatgtcaatggtggagctattgctcttggtcatccaataggtgcaagcggagcacgtattctagtcactcttttacacgcaatgcaggctcgtgataagcagttgggtttggcaactttatgtattggtggtggtcaaggcattgcaatgattgtggaacgtatttaataccaactggaaaaaaaggaaaatattatggttaaaaaagtagctttaattacaggtgcagcaagtggtattggtttggcaatatgtgagagccttgcaaccgaagatttaaatatagtgatggtggatgtaaataaagagacattaaaagaacattccactcgtttaggaacggcttatattcaagcagatctttcgaaacgtgaaggttgtaaaactgcggtagattttgcagccgaaaaatttggtagcgtagatattttggtaaatgtagcaggtatccaaaatgtagccgccattgaaaatttttccgaagataaatgggattttatgattaacttaatgcttactgcaccatttttgcttactaaatacagttggaaatacatgaaagcaaataaatggggacgtatcattaatttgaattcaatccacggtttagttgcatctgatttcaaatctgcgtatgtttcagcaaaacacggtttatcgggcttaactaaagtagctgcattggagggtggtgaatttggtattactgttaattctatctgtcctgcttatgttcgtacaccgttggttgataaacagatcgtagatcaagctcgtaatcatggaatttccgaagatgaagttattagcaaaatcatgctttctaaagctgctgttaaacgcatgattgaaccttcagaactcggcgaatttgtcaaatttctctgttctgattcagcagcatcaatctctggagcttgcttaacaatggatggtggttggactgctgcctaaaaatttatggaactggggaaattaatggaaataatcccccgagtttctctttaacttaagaggaaatatcatgagtactatcgcaattattctttcattattgatgctgatgtacttcgcatacagaggtatgacagttttattattagctcccttactggctgcttttgctgtcttactaagcggtgatggatcaatgatgatgccaaaatatacagaaacttttatgtctgcattaagtggctatttacttaattttttccctgtgtttctatttggggcattattcggtcagttaatggcagattcaggtgctgcaacaggtattgccaaaggtattgttaaaatgttaggaagtcggcaggcaattcttacagtgatcatcgcttgcggtcttttaacttatggaggcgtgtctctttttgtagtagcatttgcgatctatccgatttcaaaagtgctatttcgtgaagcgaatattcctaaacgtttgattccggcaacgattgccctaggttcatttactttctcaatgacggcattaccggggacaccggctgcaaccaacgcaattccaattcctttttttaatactaacgcatttgccgctccgggattgggtttaattggtgccatgatcatgttgataggtggttggttatggttacaaagtcgtgctaaaaaagcagcttctttaggtgagggttatggtaaacacgatagtgaatcaagtgcggatttagctatattcgagaaaaatgtaatgccatttagtttatcactacttcccttagttcttgttatcgccatgaatgcaatttttacttatactttttccaatatggactttagctcattgcaagaggtctttccaaatctcaacattaaaggcaagactggattatgggcaatcatcgcctcattattaattgcatgtgtagtattagtatttttacgtcttggtaaatggacatcattacaagaaactatcaataaaggtgtatatggttcaatgttacctatttttaatacggcttcagaagtaggttatggagcagtagttgcttcattagccggattcgctattattcgagattcagtgctaaatgtatcaactaatccattaatttctgaggctgttgcaatgagtgcgcttgctggtattacaggctcatcatcaggaggattaagtattgcaatgagaacgcttggagcagactacctacgtatgggaattgaggcaggtattgatccggatttattgcatcgagtagcagtaatggcagcaggtggatttgatactttacctcattgcggtgcaataattactttactttctatctgtcacttgaatcataagcaatcttacttgaatattgcggctgttaccattgcaataccaatagtagccgtcattagtgtgattgcattaggcacagtgtttggttcattttaagtacaaataagtcgaaaaatggaaagcttatcctgcaagtagttaaattttaaaaatttcttataggaaatgtagcaaaaacagaaagtgaaatacttatggaactgttacacgatatcaacaaaattaacccacttaaaaaagtgggttaaatttaataaaaaggtttatttcaagcaactaaaatagctatctgcggtatattgtaagaaattggcataggaatttttacctaatttaactttgtcacccatcggatccaagcgtccaacgtttacacctgttgctttacctaaactttcaattacttttggtgtaaattgcggttctgcgaacaagcaatttactttatgttcagtaatttcttccttaattttagctaatgtttttgcccctggtgcaactaatgggttaatagtgaaatagcctacttgatttaatccataagcgttattgaaatagctataagcatcatggaaaacataaaatcctttttcttttactgaagctaattgctttttaatttcgttattttttgctgctaaagtgcggttaaattcagcaagatttttttcaatcaatgcttttttggccggatattgtattgacaacttctctgctactttttgtgcaacaattttgctaatttccggtgagtaccaaacatgccaattaatgcccaattcatcatgttcatgattgtgtccatgcttgtgttcatggtcatgtttgtggtcgtgatcgtggtcatggtcgtgtttgtggtcatggtcgtggtcgtggtcatggtcatggtcatggtcatggtcatggtcgtggtcgtggtcatggtcatggtcgtggtcgtggtcatggtcatggtcatggtcgtggtcgtggtcgtggtcgtggtcgtggtcrtggtcgtggtcatggtcgtggtcatggtcatggtcatggtcatggtcatggtcatggtcatggtcgtgatcatgatgatggcctgtcattaaaagtcctttagtattaatttctgaaatttcagcaatggtaactacttttttcggatctataccacgtaaagttgcatgatctaaaaacgcatccacatcttcgccaatccaaacaactaaatctgctttttttagtttttgaatatcggaagggcggaaactatagtcatgcggagaagcacctggtggaacaataacttgggtatcagttacaccatcagcaatagatgaagcgataaaacctaaaggtttaattgatgttactatgctagcatttgccacagcagataaagaaaaaagtgctgtactaattaatgcttttttaaaggtaaaattagacattggaatactccttttcatgattaataacgattttaaaagacggactaggttatcactttttcatcaaattactagaatttttacaaaactttttagcctttggctaatttatttattatttttgctactgcaaaaaagccaaaagtcgctgttatcattgttgctgcaccaaagccattggcacaattcatggtagctgaagtagtacaattatcagccatttttggaaaaattaaaggctgagtggaaaagacacaatcgactacaaacttacgtttaggattttgcggaaaatgatattctttacgtaaaaccgaccgcacttttgccagtaaggggtcttgaatagagcgactaagatctgctactcgaatttgacttggatcggtttgtcctcctgcaccaccaattgtgataatcggaattttattgcgtttacagtgagcaattagtgctgcttttactctgacattgtcaatagcatcaatcacataatcgtagcctgtatgaatatattcagctaaattttcagcaagtaaaaaatcatcaataatattcacgtggcaatccggattaattaattgcacacgttctttcatcacttctgtttttaacttgccgatattacctgttagagcgggtaattgtcggttaatattagttacacagatgtcatccatatcaatcatggtaatttgcccaataccgcaacgtgcaattgcttcgacaacccatgaacctaccccaccaatgccaatcacacaaatatgtgtttgctttaagcgttccaaaacgtctattccatatagtcgtccaattccaccaaagcgttgttcataattatcaatacgttctgtcattattgtaataaccacactctaccatagtgcttcgataaacccgcaatatgtccggcattatcgccaattccacgatataaatcaaaatgctgcccttttactgctcctccaacatctaatgccaccattaaatgtaaaatatgttcaccggtccaattgccttcatcatcaattttcggtacttccactaaaactacagagccgcttgggatcacatttttatcgctagcaatagcagccataggtactaaaggcacaccggcagaaccaagcacttttccgttaggatcttttttgaaaaaaacataagaaggattacgttctaacaaggcttgtaagcgtgatggattttccattgcccaatttttaatggcttgaatagacattttttctttggaaatttcgccatcctctaccagcaatcgtcctattgctacataatcaaaaccattttgtcctgcataggcaaaataggtcaaatctccgtgaccaaaatcaacataaccgctaccttgtacgccaagtagaaaattatcaatcattgaatcagtgtaagccagctcaagtcccttaccttgcaaggcaccggcataaatttgagctcgagaaaaacgtttattagcaggcaaagcataaataggttgattatatttgccctgttgcgtatgacgagcatgaataaccggcgaataatatcctgtcattaatacattttggtatccgtcggttcctttcataatttgagcttgaataccatagtctgctaattgtttagtattcgcacccgccaatacccaatgagttactttgtcataaatgttcgcaaattgattagctaagccagttgatgcttgacgaatattagtaagttgcgttaaaaaatcaccttgattgatgaccgcacttttgttgtcaacagaggaaaccggcactaatgacgcttgctgataactacgcccagcatattttgccccgaattgtttcgcatcattttggctagctgttttagagtgttcggaagaacatgcaaccaaaatagcgaccgaaaataaaatactttgtttaactactgttttgataaaaaataccatatgttaccgaaaaaccgcataattagagacgtcttaaattagcaaaaaaactgtggaatatacagtcttttatcattcaatgaagataaaaaatttacaattcgcttcattttatcattggttgttttgttatttacactgatgcaaaatgtttttacgcttgaaccgtcaaataaaagcgcggtgttaatttagactactttgagtattgcaacgtcagggcttgattttgcagtccaagccctcaaaattatttaaaactcaccgcacttttaggcttcattaattccccaaagccaagccgccccacgcacaccactggaatcgccgtgtacggcttttttgatttcagtaaaaaattctctaccgaaaatataatcgttcatccgtgtcggtaaggttgtgtacagacgatcaatgttacaaacaccgcccgccagtacaatcacatcaggatctaaaatatttacataagctgctagagcttttgccaaacggcgttcataagcttgtaaagattgttcggcagtaggatcgccttgctcggcaagtgtggcaatttcgttgccttttaatcttatcccactccgacgttcgtaatcatcacatagaccggtaccggaaacaaattgttcgatacaacgatgtttgccacaataacattgtacgttatgcgaacgttcttcttcatcttgccaaggtaattcgttgtgtccccattcaccgccgataccgttagccccattccaaggttttccgtcaatcacgataccggaaccgcaacctgttccgagaataagtgccaatacgaccttttttcctgctcctgcaccatctgtggcttcagagacggtcatgcagttagcatcattggtaattcttacttctcgtcctaaaagtgcggtcaagtctttgtctaaattttgtccgttaagccaaacagaattagcatttttgactttgccggtaaaaggggaaatagtgccgggaattccgatccctactgtgcctcgttgccccgttgcatgttccgcatcatctaccaaacttttaattgctgtcaacgtgtccggatacgaccctctcggggtaggaatacgtttgcgaaacaactcttcaccgctgttacttaacgcaataacttcaatcttggttccacctaaatcaatacctatacgcataaaaaactcctataaatgaaatatgaatattgtgatccttgtaacattattttattttgatattttatatactttcctcctttaaaattattatcaggtattaatgtccaccagcatatcaattttagtcattgatgacgatattcaaatttgcgagctactcaccgatacttttgaagaatatgggtatagggttgttgcagtctcttccggtcaggaagcattaaccttattacaaaccaattctcgctttgatttgattttattagaccttattctccccgatattaacggactggttttgcttcaacaattaaaaaatctgttgaataagcccatcattatgttgagtggcttaaatagcgaatccgatgtagttgttggtttggaaatgggggctgatgattatattaccaagcctttttatcctcgaattgtagtggcgagagctaaagctgctattcgtcgcactcaaccacaagccacaaccaccgtttatacgcatagcggttttttgtttcatcaatggtatttagataccgaaacacataaactttattcgccccaaaaacaggaaattgaactgactcacggcgaatatttattattgtatgccttagtttctcacgctcaaaaagtgttgagccgtcaaaaattattagaattaacccatgcagaaaatttggaaatttttgaccgcactattgatgtattaattatgcgactacgtaaaaaaattgaaccgaatgttaaggctccgagttttattcagactgttcgaggcctagggtattgctttgaggcttcagttgaaaaactgggagaaaattaagtacgctattatgcaactcaaatcctcactttttaagtattctgcattgtttctttggtacgaataaaatcctttaatttcacatagctgactgcaccttcagtagcagagagtgaaaataaattgaaatacgccaaaccgtgtcctaattgtaaggttttttgtaacggtaaattctgatgtaatccgtataaaataccactacagaaagcatctccagcccccaatgtactcagaattttatctttttcgacccagtaggaaggaaccgtaacaatatttcccagcaaatcacaagcaaccgcatatttaggtgaatgtacaataacggctttctttacacccagttgcataatcgcttttgccgtcgtaaccaactctttttctgtagaagctatatttacttgttccgttaaaattttggcttccacatcattaataatcacaaagtccacataggataagatcgggcgaataacatttttaaaaatctgtttattttcacaggaaaccaaatcaatcgaaataagaaaacccttttcttttagcactgtcaatgtttttaccagttttgagacatccagcaacgccggcagtaagggcaaataagcgatatgggcaattttagcattacaatctatcgaggtaacagtttgatgatcatattgctgcattgctcctatgtaatgaaaaaaagtccgctctccgttttgactgttaatcattacatcagtaaaggaagtggggagatcgctttctaacattgcggttaataccacattgtgtttcttagcttgccgtaaaataaattgtccttcactatcttttccaatagcaccacttaaaaataaagagagctcgggatccaatttagataaattgaataacacattagtacagccacccccacagtgtaatcccatttccgaaatagttgccaacatcgtttctttgggataatcggagatcactaaagttcgatctaccaataagtttcccaacgccaaaatacccttacgtttttgcataatatctagctttatcgatgctgttaaaaattttcaattgttcggcaacggtttgactaatcgcatgttgcatattattcattatcatcaagtattgattatatttgccacttaattctatggatctcatatccaccgctaaggtatctaatgccgtttgagacatgccggtaaagaaattgattttgcaaatacccaattcaatagttttacggaaatcttctgcactaattcctgaaccaccatgtaataccaaaggaacatcaacagcttgattgatttgtgcaaggcgttcaaaatcaagcttaggttcgcctttatatttcccgtgcgtattaccaatcgcaactgctagagtatcaataccggttttttctacaaattccttggcttgttccactttggtataaagtgctacatctgctatactttctaacgcaccgccttcatcgccacccacggcacctaattcaccttccacagaaatattataagggcgacataattccactatttctctagtttgacgaatattttcttcataagataaagaagaaccatcaaacataatagaggagaagccacattcaatggcttgtttgacggttggtaaagttaaaccatgatcgaggtttaaacaaactgggatacttgctaattgagctttctttttaatgtatttggcggtcgcaggtaaatcgatatattgcaaatgtacttccgcgacattaataatcaccggtgattgctgctgtttagccgcagcaaatactgcatcaataaaattggaatcaattgcattaaatgctcccacggcaaatttatgttgtaccgcaacggtcagcatttcttttaaattaattaacgacataaaaattccttataatcactacaaagtaaacggataggttgttcattttcctgaatggttgaaaaacgtccaagagattctaaaaaacggttatcggtgagatcatcatttgtcattgatacctcaccaactaaaacatcgctatcttccgcccaaaagctgtggtagagcattggtggtaagcaaatactttggcctgggctaagacgaattttgctacctgcggcaacttgatattgttccccgtctatttgaatatcaatggacgaaaccttatctagcagctccgttatttcatcacgcctgtataactgaatgactaaaatgccaccgccacgatttataatatcttccatttttttccaatggtagtgcattggcgtaatttggttttgcttcaccaacataattttttcggcataaggtttattgtttctatccgactgattacgcaaggtaaatagggtcaatcccgcctgtttgaaattacctaaattaaaatccgtcacatcccagcccaaatttgcttctagtatttcagcatagcgttccagagaaagtgtatgccaatccgctagtgaaaaatccgcaaatttcggcagtacaaagtggtattttgccatcatttgctgtgcttctctgatcgcttgattaatttccgaacgcttcatattttatttcctgtcatcaaaacaatgaaaaaatctaccgcactttttagctgttgataatatgttaaagccgttgcacaaagggaacggcttggtttttctataattattttacagtccaacctttgtaatctttgatgttatcgcgattaattaaggttacaggaatcaagaccggtttttctggtgcggctttaccttgtaaaatatcgtaaccgatttctaccgctttcgctgccataacttgcggatcttgtgccggtgtgccgttaaacaagctattgctttgttttaatgcatcttcaccgtctggagaaccatctacacccatgataaaaaattctttacgttgtgcctgtttcgccgctaagtcggcaccgattgctgtcggatcattaattgcaaatactgcatcaattttcgggtgagcgattaataaggaagtcattacttctaaaccaccttcacgactgccttttgcattttgattgtgagacaataatttgatccctttatgcttagccaatacatccatacaaccttgaacacggtcttgtaccgcagaaactggtggaccgttgatgataaccacattacctttaccatttaatttatcggtaatggtttgacatgcaatttcacccgcttggtagttattggaagtgacggttgcatttgcaccatctgccgctacatctactgccacaacaacgattccggcttttttcgcacgctctactgcaggtcctatacctttagaatctgcagcatttaaaatgatcatatcggttttcgctgcaatgaagttgtcaatttgtgctacttgttgacctaaatcgtagccactggacacggatgtcacattcactttatcgccagctagttcttttgcttttaactcagcacctttggcaatttgcacgaaaaaaggattggccaaatcaccgactgttacaccgatagatttaagttctttggcttgagccaaaggagccatggccaacataacacttactgctaatgtttttaatttcataaaatatctcctatgagattatggttaaggaaaagtttgagtaatttacccaaattagtttgctttactggtacgatacttatcgatgagtactgctacgataattacgccacctttaatgacaagttgccagaaataagatacccccattaatgtcataccgttattgagagttgcaatgatcaatgcaccgattaatgtgcctgtaattgtaccgataccgccaacgaaactggttccgcctaaaataaccgcagcaatagcatctaattcatagccaacccctaagttaccgttagcactatataaacgagaagcactcatcacaccacccaaaccggataataaaccgctggtagcatacacaaaaatcaacactagagatactttgataccagttaaatgggcagcctgtaaattcccaccaaccgcataaatatgtgtacctaacgttgtgcgacgtaaaataaaccaacataccgcaattactgcaaaggcaataatgactaaccaaggaatagagcctagataaccgttaccgatccagtcaaaagaaatttttgagttaatcactgttgtgccgtcagccactaagtaagcagcaccacgaagtgcggtataagttccaagcgttacaataaatggtggcaatcctgcataagcaaccaataaaccattaaaaacacccatacctaaacctgcaactagagcaatcggtactgcaaaatcggcaagtgcaggatttaacgaacacaccaatgccatgacggcagttactcctaaaattgaccctacggataaatcaattccaccggttaaaatgatgaaagtcattcctgctgccaagacgatattaattgatgcctgacgggcaatattcatcatattggcttcactcataaaattgggggcaataaaggaaaagacgataataatcagtagcaagataggtaaaatacccattgcttggaacatatccgataatgcctgttttttagctcctgattttgctacattttccatattaagctccttacatctaaatttacgctgcaccacaggccaatgccataatgctttcttgattaatttgttcacctagaacttcaccgacaacatagccttcccgcattacataaacacgatcgctcataccgacaatttcaggtaattcactggaaatcattaaaatcgctacaccttgttttgccatttcaatcatcattttataaatctcactttttgcaccaacatccacacctcgtgtcggttcatctaaaatgaataacttcggatgaattcccatccaacgggacaacaatactttttgttgattaccgccggatagtccactcacatcgacattagcattcggcactcggatttttaaacttttaattgcctgatcagtatccgcttttccttttgtctgattaatcaccatcatggtggcatcacgttcaatggtcgcaatagttatgtttttaaatacgttcatatcaaggaataatccttcttctttacgattttccggtaataatgctacgtgatgaataatggcttctcgaggtgagctgaaactaatttcggcaccgtttaaatacattttgccttgtgtaggtcgactaacaccaaataataaatgagctaattcagaacgacctgcaccaaccaaaccggataagccaataatttcacctgctcttacaactaaagaagcattttttattttattaccgtcagaaagattttcaatgcgaatgacttcctcgcctattggtactttttctttattaaacaaatctgttagtggtcgtcctaccatcatttgtactaaagtgttggcatgcaaattctcacgtagtaaagatccaacatactttccgtcacgtaatacactcacacgatccgccaattcgtaaatttccgccattcggtgactaatatagataattgccaatccttccgaccgtaattttttgatcaactcaaacaatttttctgtttcacgggaggataatgcagcagtcggctcatccatcactaaaattcgacttttacgatgtaacgcgcgggcaatttctacttgctgttgctcagcaatggtgagagaggacactttttgataggcgaaaaattgagcacctaaacggtctaatacttcctgtgcttcttcttccattttcttgcgattcaagccaaataccgtaccgatttcacgacctaaaaaaatattttctgcaactgtcaaattcggtgaaagatgaatttcttgataaattaaagtaattcccgcaagaatggcatctttcggcgaagaaatcggaaagagtttgccgtcaatgttgatttcaccggaagtagcaatatacgcacctgccaaaattttcattaatgtacttttaccggcaccattttcacccattaacgcatgaatttcaccacgatatacatctaaatcaacatcttgcaatgcataaaaatcgccgaaacgtttggcgatatgacgcatttccaacaacggtgttacggaaatattgacagcctgctccattttaattgccctcaatctttattttgatttacagtaaagcataagtttatgaacagaacatgttaaaaactcattcatatttgtcataattccataatagaaactatttataatgtcacactcggtcaaaagtgcggtaaaaattacaaaagttttattcagtcggtagttatatgttaaaaaaacttttttctactcattcctacggtgttagattacgattgatcgtattcgtactggtggcagtttttctgattttttcaattagtgtgatgtctgtatttggattgaattccagtcataacgccctgtcaaatttacgtgatcgctccatgaaccaaatgtttttctccatgagtttaggtatcaaaaccactcagatttccacttatgccaataaactcaggcagacctttcgtgcattagaatatcaggaagcgtccaagcaactggcacagcatattgagcaagtacatcattatttggatcaaggcaaaaaatacgccagtccgttagagcaacatcaattttcagggattattcaatctattgacttattggaaaaaagtgtgcaagagctgttacaacaagcctatcaacgccatgttttgaataccagcatcatcagcaaattaaaccaatccttactttatttagaacacattaaaaggttagaaaaacgcaccgcacttttagcagacggcaaactgtttgtttctgactttcaacaaattgaaaacttgattgaaactgcgactaaaggtttattttcacctgaaacctttattgccattcgctcagtattttcatttttacccgagaaaaaacagccagatattcagcaagaatggataaaaatagaaaatgaatttgaacttatcactaaatcagcctaccaattggtagcgattaatcaacgtattcaattcttaacttatcaaattgattcgcttgtagctcaaattgaccgagattacagccgtttggcacaagaaaaaatcgctattgtgaatagtgaatctgcaaaaattcaaaccgcactttccaagcatattttgtatatttggggagcttctttattcacagtcggcttgattatcattttgggtatttatatttatcgcttattcggtaagcgtttgtattctattactcaggcgatgactcgcttatcacaaggggataaatatgctcaagtaccgcaacaacaacgacaagatgaaatcggcgaattagctcgagctttttatatttttcagcaaaatgtggtgaaactagcacgtaccgatgccttattgaaagaaaaaagtgaattgttggagcgaacttttttggcaatgcgggacggtttggcgatttttaatccctccggttgtttaatgtcttgcaatagccaatttatacaattattacattggcatgaagagcaagcacgagaggctaatttttcaagtctagcgttctttttacagcaaggttcagcaaaaatttatggtagctcggagcaaattaatgaaaaattattaagtgaaatgcgtagtgagcaagaaccattggaaatcgactattgccggcaaattttggaatggagggtaagtgccttacaagacggtggtttggtggcgtttttaattgatcgtactcaacgtaaaaaattggaaacggatttagcacacagtcaaaaaatgcgaagtatcggtcatttaaccggtggaattgctcacgatttcaataatttattggcggtgattattggtaatttagatttgatagatcctgaaactttacacgacaaacaggcaaaacgtttgcaacgtgcattaaaagcggcagaaaatagtgcaacattaacacagcgtttgctggcttatgcccgcaagcaacctctccatccgacctcattagatttaaaccagctattatttgaattttccgattttatgaaacatagcctgccagcaacgattacagtgcggttagatttagcggagaatttaccgctgatttatatggataaaaatcaattggaaacagccttggtgaatttattggtgaatgccaaagatgccttagagagtaaaggcgaaattgtgctgaaaacccgtcaattattagtccaacgaacccataaaaccgaacaaatggtgcaactgtcaattattgataacggttgcggaatgagtgaagaaactcgtcgccatatttttgaacctttttttaccaccaaacaaaacggtaaaggtagcggtttgggattgtcgatggtatatggatttattcgccaatctaaaggaagggttaaagtacaatccgaactgggtaaaggcactaagatccatttacagctacctatttcccgcagaaattcaacaatttccaccgcacttccagcgagtatggatttatctgaacgagcgacattaatacttatcgaagatcaaaaagatcttcgggaaaccttaaatgaacaacttatcgcaatgggctatcaaactctcgtatttgaaaatgcggaacaagcaatgtcgcatttatcgaaaaacgaacgcatagaatatgaatatctgttatccgatgtggttttgaacggcaaaatgagcggtattgatttagcaaattatataaaataccgttttcccttaatcaaaatactgctaatgacagggaaccatacggaatacatcgctcagttcagtgagtttgaggtgttaaataagcctttcaaacaagaagaattattggttcgtttgaaatctttatgataaagaagactgtagcaaattcctgtaattaaagtgcggttgaaagtttttctattttaaccgcactgagtttaagcataaatacagttattgactaaattttatgttatacatcgtaaatatgcttaatcagactcacaaagaatttagaaaatcttgttttatttttgtgatttttatcacgattttatggtttgaatttataaattgtgataaatatcacgtttttatcactgattaaataataaaaaatgcggtctacatcacaaatcttaaagaaaaaatttttgcttttattataaatatgttattttttctgcctgaaaaatagccaattatttctctttacgcgttctatttattgaggttaagttatgctatcagcaaatgcaaaagtcaaaatccaaagtgttggacgtttcttatcaaatatggtgatgcctaacattggggcatttattgcgtggggttttatcaccgcactttttattccgacagggtggttgccaaatgaaatcttggcgaagttagtcggaccaatgataatgtacttactgccattattaatcggttatactggcggtaaattagttggtggagagcgtggtgcagtagtcggggcgattactactgccggtgtgatcgtcggtacagatattccaatgttccttggtgcaatgatcgcaggtccaaccggcggctgggcaattaaacgttttgacaaatgggctgatggcaaaatcaaaagcggttttgagatgttagtcaataacttctcttccggtattattggaatgattttagccattctattcttctggatcatcggaccagctgtaaaagtagtttccggttggttggctagcggtgtagatgtacttgttcaagcaggcttattgccactcacctcaattttcgtcgaacctgcaaaaatcttgtttttaaacaatgcaattaaccatggtattttttcaccgttaggtatccaacaatcacaagaattaggtcaatctgttttcttcctaattgaagcgaaccctggtcctggcttgggtgtgttgttagcttatatgttattcggtaaaggggctgccaaacaaacttccggcggtgctgctgtaattcacttctttggaggtattcacgaaatttattttccttatgtgttaatgaacccacgtttattaattgcagtgattgcaggtggtgcaacaggcgtatttacattggtattatttaatgcaggcttacaagcaccagcatctccgggggcaattattgccgtgttagctatgacaccgaaaacctctttcatcggtgtgattttatctgttatcgcctcttgtaccgtatctttcgtcatttcttctttcttcttgaaaatttcaaaagaagaaagcaaaaataccctagaagaaatgcaagcagcttctaaagcaatgaaaggtggtaatacagcaacgaaaagtgcggtgatagatttgaacgaggtgaaaaaaatctttgtttcttgcgatgccggtatggggtctagtgcaatgggtgccggaatgttacgtaaaaaagtaaaagatgctggcttgacaattgatgtaactaactgtgcgattaatgatttaccagaagatgcccgtttagttattactcatcaagatttaaccttgcgtgcgaaaaaacaagttccgaatgcaatacatttgtcattacaaaacttcttagataacaaattctacgacagtttagtgcttgatttgcaagctgcaacaaaagatactgtagtaccgatagcggaagaaaatgcgattgacgtcaagggtacaacatttactcttaacgcagagcaaattttcttgggcttgaatgcagacagcaaagcggatgcaattcgtttcgccggtgagcaattggtgaaatttggtttcgtgcaaccaagctatattgatgcaatgtttgctcgtgaagaattagtttctacttatttaggtgaaggtttagccgtgccacacggaacagcagaagcaaaagatgcggtgttgaaaaccggtattgtagtgtgccaatatccacaaggcgttcgttttaccgacgaagaagacggcgtagcgaaattagtaatcgggattgcggcgaaaggcaatgagcatattcaagtactaaccgcaattactaacgcattggatagcgaagaagccattgcaatactaacatcaactgatgatatagaaaaagtgctgaccttattgaaagcttaaaagtgcggtaaaaaatggcgtagttttgactacgccatctttgtttataattttattgattgggagagcaaaatgaacgcattacatttcggagcaggtaatatcggtcgtggttttatcggcaaagtattagctgatagcggagttcaagtaacctttgccgatgtgaatgaagcggtaattgatctattgaaaagacatcagtcttataacgtgaaaatcgttggcgacagcattaatgcgatggaaagcgtacgtcatgttacgggggtggattcaaaagacacaaaggctttgattgagctgtttaaaacggttgatttagttaccactgctgttggtcctaccgtgttaaaaattatttccggaactatcgccaaaggtattgaagctcgtttagccgcaggaaattttaagccgttaaacattatcgcttgtgaaaatatggttcgtggaacgacctttttaaaagagcaggttttcacacatcttacagaggaattgcaggcagacgctgaaaaatatgtaggtttcgttgatagtgcggtagatcgcattgtgccacctgtgcaagaagatatatcggatcctttgttggtaacagtagaggaattttgtgaatggatcgtagataacacccaattcaaaggtgatattccaaacattcaaggaatggaattaactgataatttgatggcatttgtagagcgtaaattattcaccttgaatacaggacacgccgtgaccgcctatttcggcaaacgcaaaggctatcaatttgtgaaagaaagcattgaagatcccgacatcaaagagtttgtagcggctgtcatgcaagaaagcggtgcagtgttaattcagcgttacggttttgaaccgcaagcacatgccgcttatattgaaaaaattctcaagcgttttgctaatccatatttagtagataatgtggaacgtgtgggtcgccagcccttacgcaaattaagctacaatgatcgcttaatcaaaccattgcgtggtactattgaatacaatttagctaatcagcatctaattcgtgcaatagcttacgcactgactttccgttgtgaagatgatccgcaagcagtagaattagcacaatctttggcagaaatcggtgtaacagaaacgttgaaaaaatacacggaattgcaagatgtcgttattattgagcaaatagctcaagcctataatgaagtaaataaatcttagacaaaagagcggtcagtttgcaaaacttcctaaaaaatgaccgctctttctctttcaagcataggaaaaacaagttgttatctgaagatcctatttatgaaaaattaaacggtaccgtttccgtgcgaggttttatgattgctactgtggcaatttttgaagaggcggtagatagtctgatcaatcgagtatttcgaaaaacagattttgtggtacagtcggtgattgactctctttttaccaacgatggtcctcttggtgatctcagtgtacgtctcaaagtgttactcggacttggcgtgatccaacacaatctattttccgacgtaaatgcctttattcaatttaaggaaacattaaataaggacgaaaaggaatacactttcgatgatgaaattgtactcacttttttgcaaaaattaacgctgttgatggataaatcagcacttgattttgagccattaatcgaagacaaaaacagccttacttaccagatgaaatctctgcgacgggaaaaaattattcgttcttgtttaatattgaccattgcagatatttaccgtcaattacaaatcgaaagtccattttgatcatttaaataaattggtacacaacacaaaggtaagcattgattttacagctaaaaacgcatcttaaaaaacaggtaaacaggtagtataagatgtctataatgaattttttagctgtaatttttccagtaatttctgatgaattcccccaaaactaccatttgacatgaccaaaatatgatcttcaggttgtgcctcagtaacaattaaatcaactaagttgtccagatttccagaccattttgccggttgcacacaatcattagcaatttcaactacattccaaggaatattttccggttgcaataaaaaaacataatccgctcttgccaatgctggtgctatttcatctttatgaattcccattttcatcgtatttgagcgaggttctagcactgccaaaatacgtgctccgccaccgaccttgtctcgaagtgcggttaatgttgcaagaatttctgccggatgatgggcaaagtcgtcataaacagtaaccccatttacttcaccttttacttccaaacgacgtttcgcattgacaaaagaatatagtgcttgacaagcatctttgacttgcacgcccacatggtaagctgccgcaatcgccataagtgcattattcatattatgttgaccgacgatattccattgcacttcaccggctttttttccctgatgataaacagcaaaatgcgaactgtcatgagctattctttccgtatgccattcctgatcttgtcccaaaaaatgcatttcagaccagcaacccatgtctagagtttcttttacagattgttcatgagcaaaggcaagaatacgaccgctcttaggcattgttctaatcatatggtgaaactggcgttgaatcgcttgtaggttgtcaaaaatatctgcatgatcaaaccctaagttattgataataagcgtttttggattgtaatgtacaaatttggaacgtttatcaaaaaatgccgtatcgtattcgtcagcttctataacaaaaaatggactcttacctaagcgtgctgaaacaccgaaattgccggctattccacctattaagaaccccggttgcaagccattttgttctaaaatccaacttaacataccggttgttgttgttttgccatgtgttcccgatacggcaagcacccagcgatcacgtaataaatgctcgtgtaaccattgtggacctgaacgataaggtaagctattttccaacacatactctacgcaaggattaccacgtttcattgcattgccaatgacgactaaatcaggtgctggttgcaactgcgaaacgtcaaagtgcggtatgatttcaataccattttgttgtaaaaaagtactcatcggagggtaaatattcgtgtctgaccctgtgattttatagcccatttgtttggcaataatagctactccccccatgaaagtgccacagatacccaaaatatgaatatgcttattgttcatttgtttctattccccaaaatgtataaaaaatgtgttatagatcacattgtgagaaatcaattcattcgttaaaaagtgaaggttgttataataaagcaactccaactgagagtaaatttaaattatggaaggattaaattatgaaaacattaggacaatttattgtagaaaaacaagcagaatatcccaacgctaaaggagagctatcagggattctatcttccttgcgtttagttgccaaaatcattcatcgtgatataaataaggcgggactaaccaacaatattattggtaattccggcgttgaaaatgtacaaggggaaacgcaaatgaagttagatttgtttgcacataatacaatgaagcaggccttgattactcgtgaggaagtggcaggatttgcttccgaagaagaagaaaattttgttgcctttgatactgaacgtggtcgcaatgcaaaatatgtcattcttaccgatcctttggatggttcctcaaatattgatgtcaatgtggctgtcggtacaattttttcaatttatcgccgtgtttctcccattggtacacctgttaccttagaagattttttacagccgggacataaacaagttgccgccggttatattgtatatggttcatcgacaatgttggtttatactacaggcaacggtgtaaacggctttacttatgacccctctttaggcgtattttgtttatctcatgaaaatatccaaataccgccaaacggtaaaatctactccattaatgaaggacagtatttgaagttcccaatgggggttaaaaaatatattaaatattgtcaagaaaaagataaatctactgaccgcccttacacttcacgttatatcggctcgcttgtttctgactttcaccgcaatatgcttaaaggcggaatttatatttacccgagtgcaacgacttatcctaaaggaaaattacgcttattatatgaaggtaatccgatggcttttcttgctgaacaggcaggtgggatcgcaagcgacggcaaagatcggattttagatattcaaccgaaagaattacacgaaagagtaccgctctttgtcggctcaagagaaatggtcagaaaagccgaagaatttatgcgtgaattttctgaagaataaccatttgaaaagacactgttttgtgtcataaaaaatctgcaccttaatcagttgattatttagttcaacttttggggtgcagattaacatgtatattggttttgagccttacttgacagaaattagaatttataatttacatttaaaacaaatgtgcgtcctcttgaatagttatttaaggttttttggtacccatcgcccacaccaaaaataaaggtcatttggcttgcagaatcattattcgcatctaatgggctaatatatcttttatcaaagacattttgaatttcccctttaatggttaaattttctgtcggttgatagatggcataaagatcaaaaatcaccggttgtgctttgatttcttctgtaccggcaattcgtacataagtaaggtatactttgccatctttagatttgaacgtccccggtaagataacatcgccatctactttatcaactttagctcgtttacttttaccgtagtatttggcaatgccgcctaatgttaattttccgtcaaataaacgtgttcctaggtcaagggaaccgtaatctttcggtagagacgatattttacttaagccgaacccttgtaaatattttccactgctactaccgtcatttacagcactactggaatcggaatatgaacttggctgattggttttttgtctagcataggataaattggcatagaaccaaccgatatcataatttaattcaaattctattccttgcattttaacaataggcgatgaagcaacaggaatgatctccgcttccgtaccgccggtaaactcttgtggcttaaaaataccgtgagtttgtgctgctgctgtagaactaagtttattttctgcttttttatagattgttttacccccttcgtagttaatatgggtaatatgtgcaacgcagtcatcaacggatacaggtttatcttttcctctatagctgttcgagctacattcctgtttgacatttaaaatataatctctgattttcgtttgatacgccaagattttaaagcccagtacgtcgaaatccgaaaatacgccatttttataaccgttaatcccgaattgaatagttttggctttttctgattttaaatcggttctcaccgctaaatcaccgatttcagagaaatacatttctttgatatttgggacacgatgggttttggcataactcacaaatggtgaaaagagcgggtgaaaatccgcagagaatgaagccgaataattatcatgtgatctggaaccgcctttttttagtttatattccataggtctacatctagcaatatcaacatacccattataaaattttggagtgcatcctaagtttttagcaccatttacgccatacaaatcaacaaaatctttagcggtattgtcagcccatactggtaaaccttgatgtttatatcctgtctcatcccaagctccattaataaatttatttctccgaaaaacctgcccactgtatttataaatttggcgattggcatttaattttaaggtataaatatcgtatttaaaggtttggtcaaaatagagggttttaaaacgttgttcgccatcgggttggaacgtattggattttgtgctgtgataaaaacaaggaagataacctgggtcacttctctcaggacaataatataaatccggagtaaaggttggttctccattctcaaaattataggctaattcacttggatggcgatttttgctgtatttatttttgaggatattggcacctaatgttgcttcataagagaatttttctgttatcggaatggaaaaactcatatttatatccatggtttttgcactatttttgctttccaacatatctttcagctttttgccattaaatacgcttcccttgtgataggtttgcgtagaggtattatccgccaagattaattcaaattgtaaattctctttcgggtttaattggtagtttaactggtaatttttattctctaaatttctgccggaaagtgcggtcgataaagtgcggtatgaaagaatggctttattatatttatcattatattcaattttggctaaatggcttttgggataatggagtaatttattcggatcatagggttgacgattgtacttttctattgcttctagagtacaactatctatccaaaatccccctttacaactttctcgtgccagtctcggtaaattatcttctctatctacatctacaatattcgttccaccacctactttaaaattttgcgagcttttacgccaactatacgcatacataaaacctaatgttcttgtatcggaaaaaggatagcgaaaagcaaccgcacccatataattaggccctatagcgtttgtaccccccccgcattcaataaaatacccgctctattaccttcacttatcacatcatcaacaccaattgttctaaagttagcagaaccaattaacccatttacaccaccttttccactaataccacctcgttgaatatctacactggtaataaacgcagggtcaatggttgcaccgaattgagaggttccaccggatttttcgctgttatctcccgatgtggcaaaaaaggtttgggaaataccgtccaccatcgtattcacccgtccaaatcccgtttgaccacgaacgttcaccgacactgtccccgaacttttatcaaggttggtaaacgcacccggtaccgttctgatgatgtcatcaatagactgcgttgacgtggaaatattttctctcacactggttgcccccgcttttttaaagacttcctgtttaggtggtagcttatattctacgttaatttgatcgagcatttcttccgcataaacacaagtgcttaatacggaaaaagctaccgcagtgagtttaaatttattagacataattttcctacttatgtatggttaaaaagattggtaaaaaagtagggcagttatataaaaatatccctcgcatgtcaattaatgataataatttttattattattttatttccaagaatatgtaaagcctactgtgccattgcatttttatacaccaaatctgtaacgccaaacacaacggcactgtttcccgacttaatgtccgcactggcagtgtctgccgaggcatctaatttggaatcgtcagcgactaataaaatagtcggtgcattaggtgctatctaattgcattttaccggtcgagtagcaacgttccatttgattttaaagatggtattcatagtgggattccttgtgtgaaagataaaaaataagacctagttctcatatgccaagaactaagccttatcgaagaaatgaataaaaaagaggtgtattcgttagttaaaaacgaatacaatcgtgctgtgctgtcatcatagattatgaatttcttgcgtcattcttcaaaccgtctgattgtataaaaaataaatctttttgtctaactctaacaaagaaataaaaatacgtttatactgaaaattttaatttctttgttttcattgcataatagtaaaaatctcatagatggaaggaaaaaataatgaaaaatatgttactgatgagcagttctaaatacaaagataccggttacttaattcatacattaccttggttggatcaatttttgatggcatataaaggtaaaaagctcgcctttatcccttatgccggcgtgactcgttcttttgatgaatacgaaatagcggtgcaacaagctttatcttgtttaggcatggaaattatctccgttcatcacggcaaaaaacatgcagacattattgagcaagccgatgtgatcggcattggtgggggcaatacgttttgcttattacaacggatgtatgaatataatgtcatgaatattattcgggagaaagtaaataacgggacaccttattttggttggagtgcaggggcaaacgtagcgggtagttcaattatgacaactaatgatatgccgattatttatccaccatcttttactgcgttaaatctatttccacatcaaatcaatcctcattttatttcaagcaaaattcaagggcataatggagaaagtcgtgaggatcgattaaaagaatttttaatcatcaatccgaccgcacttgtatatgcgttgcctgaaggtactgcgttgcatgttcaaggagaaaaagcaacagttcttggtgaacaaaaggtgttacgttttagcgaaaatatgcaactgagtaccttagcacctcattcgacatttaattattaaggatataactatgatacagtttaattctattgtggctattcttggcattatcgccacggtttatcttctcattaaaaaatatgaaactcgtacagtattaatcagtgttggtttgttgatggcaatgttgactttcaaaccaatggaggcgtttgatgcttttgctaaatccatgaccagtagcggtttaatcatggctatttgttctagtatggggtttgcttatgtgatgaaatacactcaatgcgatacacatttggtacatttaatgactcgtccgttaagtggtttaaaattctttttaattccgattgcaacagttattacgttctttattaatattgctattccgtcagcagcaggttgtgcagcggctgttggtgccactttaattccagtattgaaaagtgcgggtgtacgtccggcaacggcaggtgcggcgattttggcagggacttttggttcaatgatgagtcccggatcttctcatagtgcaatgattagcgaaatgtcgaaattgaccattaccgaagtgaatttgtctcacgcaccttacactatgattgcaggtgcaatcggcacagtagttttaactttgttagcgattgtatttaaagattacggtgaggaacatcggaaagcctatttacaagaaaatcaacaaacggaaagtactttcagtaaggtgaatatattctatgctttagcacctctcgttccgttgattatattggttctcggcggaacctctttagctgaaaacccaggattagcgtggacaaaaatgggcgtgccacaagcaatgttaattggtgcgatttatgccattttagttacccgaatttctccggttaaaattaccgaagaattttttaatggaatgggtaattcttatgccaatgtattagggatcatcattgccgcaagtgtgtttgttgcaggattaaaagcgacaggagcggtagattccgctattgaatttttgaaacattctaacgaatttgtccgttggggagcgactatcggaccattcttaatgggtttggtaacaggttcaggtgatgctgcggcaatcgcatttaataccgctgtaacaccacatgcagtggaattgggttatacccatgtcaatttaggaatggcggcggctattgccggagcgattggacgtaccgcttctccaattgcaggagtaaccattgtttgtgccggtttagcaatggtaagtcctgtagaaatagtgaaacgtactgcactgggtatgattttggcaaccttatttttaacgttatttatgttataaatataagtaagactgaccgcactttgataattcatttgacaaggtgcggttaaagtttggagagtttaatgggggatatatgacgaatttagctagattaattgaatggcgaagagaatttcaccgttttcctgaaactggttggacagaattttggacaaccagtcgcatcgctgattatttagaagaaatgggggctgagattttactcggcaaccaaattattcatcatgattttgtgcgtggtcgtgatacgaaattagttgagaaaggcattgaaagtgcgatttcttatggtgcaaaaaccaaatggctagaatgaatggctatacaggttgtgttgctgtatttgattctggtaaacagggaaaaaccttggcattacgctttgatatagattgtgttaatgtgactgaaaccaatgatcccaatcatttacccaataaattaaaatttgcctcattaaatctagggtttatgcatgcttgtggtcatgatggacacatcacaattggtttaggtattgcgtcatggctttcacaaaataaggataaatttaacggtaaagtcaaaattgtctttcagcctgctgaagagggagtgagaggcgcagcagctattgctgcaagtggagtgattgatgatgcggattattttgcctcttcccatattagcttttgtgccaacacaggtactgtcttagcaaatcctcgtaatttcctttccacaaccaaaattgatattcgttataaaggacgacctgcacatgctggtgctgctccacatttaggtcgaaatgcattattagcagcggctaatgccgtaacacaattccatagcattgctcgtcatggtgaggggatgtctcgaattaatgtaggtgtattaaaagcaggtgaagggcgtaatgtgattccgagcagtgcggaaattcaacttgaagtacgtggtgaaaataaagagattaatcaatatatggtggatcaagttatgcaaattgccaaaggtattgcgattagtttcgatgtaagttatgaaactgaaattatgggtgaagcagtggatatgaataatgatcttgagttagttaaattgatcgaggaaattgccattcaacaacctggaatcaatgagtctactgctgattatgcgtttaatgccagcgaagatgcaacgattttagggcgtcgtgtgcaagatcatggtggtaaagcgatttattttattattggtgctgatcgtacagctgggcatcatgaggcaaacttcgattttgatgaaaatcaattgctgactggggtaaatatttatattggtttagtacagcggttattggggtagtattgagtttttaatttattttcgattaaaaagtgcggtcagtttttcatgagaatgaaaactaccgcacttcttgtctattgaattattaacagttctagcagttttttttgctttcaggtacaatcagccgattaaattttatcttatattaatgaaaaacttttagattttatttttatgaaaaatattcgtaacttttctattattgcacacattgaccatggtaaatcgactctttccgatcgcttaattcagagttgtggcggtctttctgatcgtgaaatggaagctcaagtactagattcaatggatttggagcgtgagcgaggaattactattaaagcacagagcgttactttaaattacagagctaaagatggtgaaacttatcaacttaactttatcgatacaccgggacacgtggatttttcctatgaggtatctcgttctttagcggcttgtgaaggggctttattagtagttgatgctgggcaaggcgtagaagcacaaaccttggcaaactgttataccgccattgaaatggatttggaagttgtacctattttaaacaaaattgatttgccggcagcagaacctgagcgagtcgctgaagaaattgaagatattgttggcattgatgccattgatgcagtgcgttgttcggcgaaaaccggtgtgggtattgaagatgtattagaagaaattgtacgtaagatccctgcaccggaaggtgatccgaatgccccgttacaggccttgatcattgattcttggtttgataattatttgggtgttgtatctttagtgcgtgttaaaaacggtattttacgcaaaggcgataaaattaaagttatgtcaacgggtcaatcttataatgttgatcgtcttggtatttttacaccaaaacaagtagatacaacagagctgaaaacaggcgaggtaggttggcttgtttgtgcgattaaagacattttaggggcaccggtgggagatacattaacttcacatcataatccggcaacctctgtgcttccgggatttaaaaaagttaaacctcaagtttatgcagggcttttcccaattagctctgatgattatgaatcatttcgtgatgccttaggtaaactaagtctaaatgatgcgtctttattttatgaacctgaaaattctaccgcacttggcttcggttttcgttgcggttttttaggacttttacacatggagatcattcaagagcgtttagaacgtgaatatgatcttgatttaatcactactgcaccaactgtggtttatgaagtggaacaaaccaatggcgaagtgatttatgtagatagtccggcaaaattacccccactaaacaatattgctgaaattcgtgagccgatcgcagaatgtaatatgcttttgccacaatcttacttaggtaatgttataacactttgtgtagaaaaacgtggagtgcaaacgaacatggtatatcacggtaaccaagtggcactgacttatgaaattccaatgggtgaggtcgtgttggatttctttgatcgccttaaatcaacttctcgtggttacgcctcgttggattatggttttaaacgttttcaagcagccgatatggtgcgtgtggatattatgatcaacggtgaacgagttgatgcgttagctttaattgtacataaagacaatgcacaatatcgtggacgtgaattggtggaaaaaatgcgagaacttatccctcgtcaacaatttgatattgctattcaggcggcgatcggcaaccacattatcgctcgttctactgtaaaacaattgcgtaaaaacgtattggcaaaatgttatgggggagatgtaagtcgtaagaaaaaattgttacaaaaacaaaaagaaggtaaaaaacggatgaaatctttaggtaatgtagaagtccctcaagaagcgtttttagctattttacatgttggtaaagataagtaaggaaacaccaatgtctaaatcaaatttatttttcgttatattaattgcagcgggatatgccatttggaaattacttgatcatttggcactaccgaatacattcaatattttattaattttattgaccgcactttgtggtgttttatggtgctataaccgttttgttatcttgcccaagcggagcagacaaatttctcgtgcagaacagcgtagcggtaaaatattaacggatgaagaaaaaagtaaaattgagccgatttctgaggggagtgaattgttagcttccctatttcctgtattgactttcgtacttattttacgttcttttctttttgaaccgtttcaaatcccatctgtttctatggagccaaccttgcgtgtcggggattttttattggtcaaaaaatatgcctatggcattaaagatccgatttttcaaaacacacttattgaaacgggaaagccgcaacgtggtgatataattgtctttaaagcacctttagaaccaaatattgattatattaagagaatagttggaatatccggagatcgtgttttttatgatgaaaaaacgcgtcatgtgacaattatttataataaagacggcaaagaatgtgtttatgattgtcaaataaaggaatttagttacagcgagccacagcgtaatcctgaatttaccatgatcgttggtaaggatgcacaaggaaaagctatctatggcgatgaaaatcctttggtcttaactgagaaaggcgatgtggaacatcaaattcattgggatccacgcatttttaaccgcacttatatgtacagtggttaccgtcagcaaaaagattacgtaaccgaatggattgtaccggaggggcaatattttgtgttgggtgacaaccgagatcagagtgcagatggtcgtttttgggggttcgttccggaaaaaaatattgtgggtaaagctgaatttatttggttgagtcttgataaaaaacaagatgaatttccaaaaggcattcgtttctcaagaatgtttacctcaattaaatgacaaattattgacttaataaaacgccctttaaattaaagggcgtttctgtgttatgaaaaatccggtaaaagtgcggtagtttagtcgcaaaaaataatatgtctttcttttattttcaaatagattaaataggggtattatgttccattatttttgatgtggaacatcaaatttacgtttcttattgatattcttgaaaaaaattatgcaactggaaaaattacaaaaaaaattaggtcaccaatttactaatcttgattatcttaaacaagcattaacgcatcgaagtgctgctgcatttaataatgaacgtttggaatttctaggtgattccattctaaattttgctattggcaaagcactttacgaaaaatttcctaagtctaatgaaggtgaattaagccggatgcgtgcaacgttggttaaagaacaaactttagctgttgtggctcgccaagttgaattgggtgattacttaaaactaggtgccggagagttaaagagcggtggatttcgccgagaatctattctatctgattgtgttgaagcgttaattgcagcgatttatttagatgcaggaatcgatgttgctttagctcgagtttatcagtggtatcaggaattacttgaacaaataaaacctggagaggcacaaaaagatcccaaaacacgcctgcaagagtttttgcaagggcatcgcttaaaacttcctgaatatgaagtgatagaaattaagggagatgctcacaatcagtcttttagagtgagctgtaaagtggaaacacttactgacgtcgtttttggacaagggaccagccgccgtaaagcggaacaacatgctgctcaacaagctattgaaaaactgaaaattaaataactatacctgtcgggacaatatttttttgtccttgcataatatgagagaaaaaatgacagaacaagaaacttattgtggttttatcgctattgttggacgtccaaatgtgggtaaatccactttattaaataaaatcttaggacagaaaatttccattacttcacgtaaagcacaaacaacaaggcatcgtatagtcggtattcacactgaaggtgtttatcaagcggtttacgtagatacacctgggttacatattgaagaaaaacgtgcgattaatcgcttgatgaatagagcagcgagtagtgcaattggcgatgttgatctgataatttttgtggttgatggcacacactggaatgacgatgatgagatggtgttgaataaattacgtcgtgcaaaagcacctgtcgtgttagcaattaataaagtggataacattaaaaataaagatgaacttttaccttttattacagacgttagtcaaaagttggagtttaaagaaattatcccaatttctgctcagcgaggtaataatattcacaatttagaaaaaatagtccgcacttctttacgtaaaggagtacaccattttccggaagattatgtaacagatcgctcacaacgctttatggcatctgaaattattcgggagaaattaatgcgttttacaggggaagaattaccctactccgtaacggtggaaattgagcaatttaaacttaatgatcgtggtatttacgaaattaatggcttaattttggttgaacgtgaagggcagaaaaaaatggttatcggggcgaaaggacaaaaattaaaaactatcggtactgaagctcgtcaagatatggaacgtttatttgataataaagttcatcttgaactatgggtaaaagttaaatccggctgggctgatgatgagcgtgcattacgcagtttaggttatatagacgaataaaataaaacattaaggagacaaattatgtacttggaacaagtgaaaactgagttatttgaagcacaagatgtactaaataaatttatcagtaacgaacaaaatatcaagctcattcaacaagccgcattactgatttcggatagttttaaacaacacggtaaggtattatcttgtggtaatggcggttcacattgtgatgcaatgcattttgcagaggaactaacgggacgttatcgtgaaaatcgtccggggtatccggcgatagcaatctcagatgttagccatttaagctgtgtaagcaatgattttggctatgaacatgtattttctcgttatgtagaggctgttgggcaaaagggcgatgtattattaggcatatcaacctcaggtaactcaaaaaatgtattaaatgctattgaagcggcaaaagccaaaggtatgaaagtgattgccctgacggggaaagatggtggaaaaatggcgggacttgcggatgtggaaattcgtgtacctcatttccgttttgcagatcgtattcaagaaattcatattaaagttattcatattctaatcatgttaattgaatttgagatggctaaaattagacagtaattttttaacctttttgtactattacagagaaagattttatgtcatattacaataatgcaatcttccctttgcttttagtgtaaatttagattaaaatcgcaacccttgttttagggtcaataattcgtttattgaacaatattaaattttgcaaaatattaattaatcattgaggtgatggcttatgccagtaattaaagtacgtgaaaacgaatcattcgacgttgcattacgtcgtttcaaacgctcttgtgaaaaagcaggcatcttagcagaagtccgcagtcgtgaattttatgaaaaaccgacaactattcgcaaacgtgaaaatgcaacgcgtgctaaacgtcatgcgaaacgtgtggctcgtgaaaatgcacgtaatacacgtttgtactaattaaaaaatttttttaattaaactcgagttaaacagaccgtgaaacctcataggaatcacggttttgtttcttttataaattctctatcatatttgcttttatagtattattaggctagtttattcctatttgatgctattttagggatttatcttttttatgtcaggcaaaataccgcattcatttattgatgatattttagctagaacagatattgtagatctgattgattctagggttaaactcaaaaaacaagggcgagattatcaagcctgttgcccttttcatcatgaaaaaacaccttcttttacggtgagtccgaaaaaacagttttatcactgttttggttgccacgcacatggaaatgcgatctcatttttaatggaatatgataaattagaatttgttgaggcaatcgaagaactggcttctttgcatggtttagaagtcccgagagagaaatctacgcttgatgaaaaaacacgagttagttttaaaactaaacgcaatctgtacgaactaatgcaagaaattgcaaaattctatcaagagcaattaacgcaaaatatccccgcacagaattatttacaacagcgtggtttatcaatagaaattattcaacgttttcaaatcggcttttctccacagcaatctagtttttttataaaaaaatttgccacaaatagagaagaaattcagaaattatttgatgtgggaatggtaaataaacgagagagcggtgaattatttgatcgttttcgtcagcgagttacttttcctattcgagatagaagagggagagttattgcttttggggggcgaattattacccaaagtgataacagaccgaaatacttaaactctcctgagagcgtaacttatcataaaggttatgaactttatggtttatttgaagcgttacaaattaatgatagtcctgaaatgttggttatcgttgaaggctatatggatgttgtcgctttagcacaattcggcgttgactatgctgtggcatctttagggacagcaactactactgagcaattacaattagcctttcgttcaacagaacaaattatttgttgttatgacggtgacagagcaggaagagatgcggcttggcgtgctttagaaaatgcacttcctttattggaagatggtaggcaattaaaatttatttttttaccggaaaaagaagatcctgatagttttattcgacaatatggcaaagaaggatttgaggattatattcatcaagcacaatcattaagtgaatttttatttaatactttaagtgctaaagttgatttttcctcaacagaaggaaaagccaaattagcttctcttgcaattcctttaattcagaaagtgccgggagaaatgttgcgattgtctttacgtgatatgttcggtcaaaaagtaggcatatttaatccggacaagttagatagattactatccaatcaacaacaggttgaatataaacaaaaaattccgaaaacagtaaaaagaacaccgatgcgagttttaatcgcacttttattacaaaacacaaatttagctaaaattgtccctgatttatctccactaaaagttttacaagagccgggcttggatttatttgaaaaaattgtaatactttgtcgtgaaaatgttggtatacgagctggacaaattttggaacattggcgagacacggaatatagccaagcacttgaaattttagctacgtgggagcatgctgttgatgatgataaaattgagcaagaatttagagaaaccttgattcatctttataagcagttagtcgataagcgtattgaagaattaattggtcaagaacgtatggttggcttaactaatgatgaaaagatagaattagcacaattattatcgaaaaagcaagaaaagaaatagttaatcttttataagaatggtagaattctccattcttcaatccttattaatcgaggcagatattaaatggaacaaaataaacaatctcagctgaaattgttaattgcacgaggtaaagaacaaggttatttaacttatgccgaagtgaatgatcatcttcctgaagatcttgttgatgctgatcaaattgaagatgtgattcaaatgatcaatgatatgggtattcaagtacttgaaagtgtgcctgatgctgatgacttgatgctcaatgaaaatattacggatgaggatgctgttgaggaagcgactcaagtattatcaagtgtagaggcagagttaggaagaacaacagatcctgtgcgtatgtatatgcgtgaaatgggaagtgttgaacttcttacgcgtgaaggcgaaatcgatattgcaaaacgcatcgaagaagggattaatgaagtacaaagtgccgtagccgcttatcctaaagctctcaattatcttcttgaacagtatactttagttgaagaaggcggtatgcggttggctgatctcattaccggttttgttgatccaaatgcggttgttgaagaagagataattgaagccgacgacatacttacagaagatgatgaagaacatgtagaaagcaatgttgatgtaaacgatgaagaagaggaagaagatagcgaagataatagcaatgtagactctgattcggataacacaattgccccagaagttgctcgtgagaaatttgaagcactaagaatacaacaccaaaaaaccttagccgcaatagaaaaatatggtcgttcccgtaaacaagcaaaagatcatattcaagcattagccgatatttttactcagttccgtttagtgcctaaacagttcgatgcgttggtcaattatatgcgtgatatgatgaaatctgttcgtcagcatgaacgacaaattcaaaagctggtagttgatttggctaaaatgccaaaagaaaatttccaaaaattatttattggtaatgaaagttcagagggttggctggataaattactgcttgcaagaaaaccttggtctgaaagattaatacaacatgaaagtgcggttcgtcaaagcataaaccaattattaaaaattgaacaggaaaccaatttaactatttctcaaattcgtgaaatttgtgacaaagtggcacaaggagaattaaaagctcgccgtgcaaaaaaagaaatggttgaagcaaatttacgtttggttatttcaattgcgaagaaatacactaaccgtggattgcaattccttgatctcattcaagaagggaatattggtttaatgaaagcggtagataaatttgaataccggcggggttataaattttcaacctatgcaacttggtggatacgtcaagcgattacacgctctattgcagatcaagcaagaacgatccgcattccagtgcatatgattgaaactatcaataaattaaaccgcatttctcgtcaaatgttacaaaaaatggggcgtgaagccacatctgaagaattagctgaacgaatgggaatgcctgaggataaaattcgtaaagtattaaaaatcgcaaaagagcctatctctatggaaacgcctatcggtgatgacgatgattcccatttaggtgattttattgaagacaatacgttagagctaccgttagattctgcgacagcccaaagtttgcgtgctgcaacgcatgaagtgttggaaggactaaccccaagagaagcaaaagtcttgcgtatgcgttttggtattgatatgaatacagatcataccttggaagaagtcgggaaacaatttgatgtaactcgtgaacgtattcgtcaaattgaagctaaagcattgcgtaaattgcgtcatccaagtcgttctgaaaccctacgcagtttcttagatgagtaaatgatgagattaaagaaagttatcacgttcttttctcaaacattttggcacgacaaataatcaaaattaacctaaaaaatataatccctattgaaagaaatggctcaatagggatttttcgttatgctaaaaagtgcggtgattattcaatcctatttgagcatcaaacatttttaattgttcgcctcaattaagttaggataaaaagtaaaaaaatcgtttctttcctataaaaatttaggataaaataacgagaattttcacttgacaaataaaatagaacggaaaaaatgacagtctacagtctacagtctacagtctacagtctacagtctacagtctacagtctacagtctacagtctagtatattgcctaaaatcaaccttgcaaggtaaatttgtgaggttggatatgttcaaacaatatcttaaaaatcacctatttcaacctcaacctttcggcgaaagtattattcgcctttttctgctatgccttaaaaagcaaggtatcgcctatttaggtttataacctatctctctaaagtttaataaataatcagtaagagataataaataaacaataacagattcgatcaataaccatttaataagtaattaacagataatttttaaagcgagtaaagaatatgaacaaaatcttcaaaaccaaatacgatgtaacaaccggtcaaacgaaagttgtgtctgaattggcgagtaatcgtcaattggcgagtagctcgaagagtaaaccgaagtgcggtgcgtttttgggtaattttttaggcatttttaaattttcaccgttggtgttgttgatgtcggggatgcttggtgtgagtagtatttcttacgctgctgttgtatatattgatatggaagcaactacaggtgctgctggagtaagacaagattggagagaatcacaatattggaaaaatagaggaagtgaaaatattttaatagcacctgttcaagctgatagtgttaatcaaaatttaaaaaggtatggtcgcggaataaatacaagggtacaaaaatctgtaatcataggtcctatggcggcaggtagagatgatcaagcaggtatgactgtattaggtcatggtgcagtcggttatagtagtcaaacaactgcgattgggaataatgtctatactggaggtgaacaagctacagcgataggatcagatgttatggcagcagggtatgcctctatcgcaataggaaatgatgatatatatagtcaaggtggatacgccgacgcattaccggaaaatatcattatggaaatctatgggtatgaaggtaatcatcaaggaaaaacaacttacaaggatatcttagacagagatatatttgtagataaatatgggaaaaaacctaatcaagataatagacactattctccaacttattcagcaggaatgggagcaatcgctatcgggtcaagatctgttgcctatggtgatacttcacttgctttaggaaccttatcatttgctttggctaaaggctcaaccgctgttggcgttcgtgcatttgtgagtgaagatgcagawggcggtgttgcgataggtgacgmatctagggtwtttgcwsckaattcatttgctrtaggwaatkawgcagargcarcaaataaaggkgctgtatcwtayggytcarrmgcaaaagcrgtgggwrmcggttctrtmgcaataggcaccaaagtagcctctaatgctaagataaatgaggcttcagctagaaggtttagagacaagcttatgcaagaactaggtattggaactattcgggaagataaacaaaaagatgttaatacaataataacaactgaagttaaagatttaaaaactggaaatcagaatgagattgttaaatctgggtttgctaatcatttagacgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatcagtaaaaaagaaagagagagagggaaatcacgctataactgtgggttactataccgcaaatagtggagataataccgtagccataggcacagcttcctatgtaaaaggtcaaaattctgtcgttttaggagctttgaacaatgtcgggaaatatgcaagtaatgcggtagcgattggggttggaacaaatgtacataaagaaaactcaatcgctttaggaacgggaacaacagtaacaggtgcgggcgttgtggctatcggttccggcgttggtgtaacaaaagacaatacaatagctgtgggttatggagcagtaggagaatcaagcgaaagtattatcttaggaaatgaagcaaagataaaggatcaagcaaaaaaatctatagttatcggtaatagtgcaaaagttgaaaannnnnnnnnnnnnnnnnnnnnnnnnnnnnnnnnnnnnnnnnnnnnnnnnnnnnnnnnnnnnnnnnnnnnnnnnnnnnnngaaatgtccgctattgctatagggacaagttcatctgtttatgctacaaagggcgtggcattaggggataacgcaagtattggaaaagatgctagtagttcaatagctttaggtaataatgccgaagcagatatgatgaactcggtggcgttgggttatcaatccacaacaaagtatttttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagtgcggtcggtttacgtcggattgtcaatgtggcaccgggtgctttggactctgacgtggcgaccgtggggcaattaaaagccttgaactacgtcaaaaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgggcatttagcgaaaggggagatttcagaggtttccgatcaggcgattactggggcacaacttgatgatcttaaaggtaagttggggttgacattagataaagatgatccaacaaaatttgataaagttaaatttaacgcagtaaatgtaaccgattcaagtgatacatcaggagtaataacaacttttgaagaggctatccgtaaaagtattgcagctatcaatagaggctataaatttgacgatggaactaataatcctactactaaagatacacctttttatttaggttcaaccattgtaatcaaagcaggggatgttacaaagtcaggtacaacgacagagaactatctaggcaaaaacctaaaaacagaatttaaaaacgatagttcaaaagcgacattcaccatcggcttgaaagacgatcctgaatttaaaactgtaaagattgacacgattgaggataaagaaactactgataaaaaacttgccgtcaacaaagagtatgtggataacaaactcaaaaatgtctcgaccaatttacatttcttatcagtacaagggatggataaaggcaatggttcaaattacaacaacgacggggcaaaaggcactcattctgttgcaattggggtgaaagcaagtgctacagcaaatgcgacgtctggtatagcgatagggtataacgctaactctaaagcagaaaatgcagttgtaataggtaataatgtaagtgtagatgtacatagttcgtttgtactagggtctaataataaagttacgcaatcatttaaaaacataaatggtgctgtggttgtaataggtagtggaacagaattaatagaatctaaaagttctatagcaataggtgctgtatttgtaaaaggtaaaaacggagaagatggaacaaaaatagaaaacgccgcttggacagcgtctatcggtaataaaaataaaatcaaaaacggtacggatattgtggcgttagggaacaatattcaagcattagatacgacagatgaaatgtctagtaatggaacaaagaatgcgaatacagatttaattctgattggtaatggagcgacagctgaaactgcaaaagaaagtgtgcttattggggcaaaatcaaaagctgaaacgggtgcaaaaagtgcggtgattattggtcatagtgctaaagccgagagagacgccgtcggtgcagtagcgattgggcaaggtgcaacagtaaaaaccgccgccggsractccattgccttagggcaagggtcagaagcgactaaaaaagaaaccgcacttcatgaagctaaaatannnnnnnnnnnnnnnnnnnnnnnnnnnnnnnnnnnnnnnnnnnnnnnnnnnnnngaaaacaataaaaaatccgttttaagcataggtaaaacaggcaggtaaagacgtatcaaacacgtcgccgcaggtgcggtaacggaaacttcaaccgacgctatcaacggaagccaactttacgccgtcgctgatgaattttcaaaattagcggtgaatgtattaggtgcggaagttgatacaactagcggatttaagaaatcagaatttaccgttgttcaatatcatggaagtacaaatacaccaacacaaaaagaaatgacttttaaagacgcaattggtcaaaatacaatagcgattaataaaggctttatttttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattaattacagaagaaattcctgaggataagtcaactgatcctaagaaaggtaattatgataagcatgctgtcaacaaaaaatatttagacaaaagattagaaaaagtcgccgctaatttcacggttaagggggataattctaaagatggaaaaagttataccttagataaagagcataatgaattaaatattaatggagatagtgaaaatatcacaaccgcagttgttgatgataaaggaataaaaatatctcttaamaaagaattaamaggtatcacttcaattgctaataatgatacaaaaattgaattaaacaatggaactggtggaartggaacaaaatctatcgttttcacmgytggaaattcarrtaagaaagtaacattaactgaagataaattcagtggtgtgtctgaaattagcagtaaagacagtaaatctaaattaaaacttggtgctgataaagcaactgtagaattagctcatgacaaatcaaaacttgaattaaaagatactgaagcaacaatcacagctggaggtaatgccggaagtattaaaattaacaataatggtgataagaaaattgagttaagtcctgaaaatggagctaaattaacacttgcaaaagataacggctctagcaatgttaaagctaccggtttatctcttgttgggttaaatgaacaaaacgctttaatctttaaaaatnnnnnnnnnnnnnnnnnnnnnnnnnnnnnnnnnnnnnntacaacctataaattcactgaaactggattagatttagctggcaaaccaatcacaaatctaggaagtggattagatcaaaatggtagtggtggtactaatgtaagacaaggcttagacgagttgttaaaacttattgatagcacacaaacaggtacacaaaatcaaaatagcgataaattaaacaaagccatcaatgcaggcgatttgcttcatgtcgctnnnnnnnnggtgaataaaggcttgacgtttaaaggtaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaataaagcaacttctgtagataaaaatgacgaaaaagtcgttacctcaaaagccgtagcaaaggagttggaaaaatataccaagactactgatttagttgataagttaggcacggcgtatttaaaagtagatggatcgaatattggcgaggcttccaataaaaaaacattcggtagcaatgtcggtattgctgaaatcaagttagatggtgaaaaaagcagtactgaattagtacaggcggatgcggttattaagtatctaaaaggtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcggaacgcatgcttacgccgtgggtgcttataatgacatcaaaggcgaacatacttatgtcttgggttcaaatattacgacaactaaagatataacaaatgctgttatcttaggtaatagatcaacaggtgtatctgatgccgtgtctgtgggtagtgcagataaacaaagacgaattgtttatgtcgccgatccaaaaaatcaatacgatgcggtgaataaacaatatgttgatggacttggattaaaattcaaaggtaatgataatcaagagatacataaaaaattatcagacacattagaaatagttggtaagggtttaaataaagctcaaactactaaatttaatggcacaaatggaaatattgcggttataaataataagcaaaataaattggaaatatcattaaatagagatttaaaaggaattaaatctattagtgatagcaagaataaaaatatagctactgaaataagattcaatagaaaaaatgacacaaacagtatttctaatagtttgataacgaacctaactatttcttcaaatggaggcacatttgaatttaatagaacaggtttgcatatcaacaacaaacaaattacagggttaagaagcggactattagaaaaacacaacggaaatgattctgaaagaaaaggtttagacgatttaataggagaaaattttgataaatcatcgattaaaactcatgcagtcaatgttggagatttagctaaaatttctaaggaaatagttgaaaaagggtataaatataacgctgatattctgtcaggtaatagcaatgataccagcataaaactaggctcaactatatctattgttaaatggacaaactcgccggcatcggggactggacaaccagcagtaactgttggcacaggaacaacttctcaaacacaagctgttaagtacacaggagataatttaacaactcgatatacctatgacggtggcaacgctaagatagaaattggatttaacgaaagtccgacatttaaagctgttatgcttgctgaaaatcaaacatataatggcggaaatgcagttgatggcaaagaactcatcactaaaggctaccttgaacaagcgttagataagtttaagttcaaggttgaaaatggtagcggtaagcctatagaaatcggtcgtggcgatacgttgaagtttaatgctggcttcaatattcaattaacgttagctaaagagggtgaaaaaccggcaaatggggcaacgtctgcaagtagcacaagtgcggtaacttctaccccagctccgaccgctccagccgtggcaagtagttcagacagttctgctccagctagtaccacatcaggtagtgcaggtggtgcggttgcgtcaggtggtacaaatggcgatagtgcagatacwgyggtcgcttcaagctctccaactgcgggaacttcaagcacamcaacgaccacgccaagcgatacgagtacaccaaccactactacaccaacaacggcwgtrgtmaccattggcacgamwrakgatttrammrayatyacctckatttcctctaaagctggaagtgcggrcggaaatgatgcaaatggtrcaactggagamgtgactaaacttaccttagatccaactratggtgcgactttccaagtgggtagtcaaggtkckaaagtgaawattgataaaratggtatttcactsaygccacaaggggcgaatggtgcagatggggcgaataryycammtgytgaawcrccatcwatyrytattaamgcaggtrcaaaaccrgyggatmmaaayagcytagaatcgtttgagaaagrtcaagrwccwtctattrcgttctccacaaaagatactgayggtaagaaaatcggctcaggcaaaatcaccggtcttgctgatattaaasmggrkgaaamagacggcaccmtygcagcgaataaaaactatgtggatgaaaaagtatccgacttaaacaataatcgcccgtttgatttttatttaggcaatgaaaaagtcgtgaaaggggctgatggcagtttccacaaagacggtaaacctagtgaaaaactttctgaggaagagaagaaacaagtcgtgattaaagccgaaccaagcacctcacctatcgggattagcaatgtggcgagcggtttgggattagctgcccctgaaaaagacatggctaaagcggaagaagcgaaacaaaaaaccgcagaattggcaaaagcggttgagggtaaggtgaaagatgtcggtgataaagccaaaacactatcccaaaaagcacaaactttcacggatttagcgttagcggtgaatagcttagaacaggcgataaatgcgttgccagaaggcgaggataaaaagctggcagaaactaagttacaagaaagcaaaacgaagcttgatgaggctaaaaaagagcttgaaacagcaaaaactgctttaactgaagctcaaaaaggcttaacaaatgccaataacgcctatgaacaaaattacaaaggctatgaaaaagtcgctgacttagtcagtgccgatagtaaagccgaattaaccaacgtagccacaaccggcgatttgcaagcggtggcgaaatccggcatgaagttcaagggtaatgacggcatggaagttcgcacgccattaagcggtaccttggtgatcacgggcgagggcgacacatttaacagcaacctcaccgccgccggcaatatcaaagtggaaatggcacaagacggtaaaggcttagaagtgaaattgtctgatcaattgaaaaatatgacttcgtttgaaactcgtgaagtgaacggtaagaaagcccgcttggacagcaacggtttgagagtggaaaatacaagcacaaaagaacgctctcatttaagcgaaaaccgtttggcgttctatgatgaaaaaggattgggattgaatttagatggcaaagatcgagccttaaaagtgagtgaaaaagcgattattagcatcaacggcaaaaatgaggctttagttgaagatctcaatgcctctagttcaggtcaggcaattgcgaataaaaactatgtggacgcaaaaaataatgaattgcgtacacagcttcatagtgttaatcgtgaatcacgttcaggaattgccggtgcaaatgcagcagctgcgttgccaatgattgcgatgccgggtaaatcagcacttgctgtctctgctggggcttataaggggcaaagtgcggtggctttgggctactctcgtatgagcgataacggtaagattatgttgaaactacatggcaacagcacctcaaccggcgattttggtggcggtgtcggtattggctgggcatggtaagtaacgccctttgagctaaaaaagcagtgaatgatgatctgctccttaatcagttggttgtttagtccaacttttgggtgcagatcggaatcactgcttttttgatgcggatttactatgatactttttaatggtgatggaactgtaatatcatcaccagcccagtattagtcttaggtgaaagcggttagaatatattaacttctgtcctcgaaaaagaaatattcattgagggtgatagaagaaattcactgatgtattaggggagttagtaggaatttcgttttttagagagaggagaacatcaatatatgaaatattcgtttatttcataatgaatcggcatataatgtcaacctttcatgttaaataaaggattcgcattatggaattttctgtttatctacaattttttattgggttaattgcgttggttaatccaattggggttgttcctatcttttatatgatgacatctggtcaaagtcgtgttcagcaaagtcatactgctatgattacttgtttttcgattgtcgttattttattgatcagtttttatttcggtaatttcattttaagttcgttcaatatatcgattaattcattcagaattgccggcggtattgtcgttgtgatgattgctttaactatgattaatggaaaaattggtgatcacaaaattaataaagaggaacaaaaagaggattttagcgaaaaagataatattgcagtcgttccgttagctatgccaattttagcgggtccaggatcaattagtgctactattgttctaggttctagtcagagttcatggagcgaatacttatattcgtctattacaatcgcactttttggtttaacttgttatattttatttcgttattcagagccagttatagaaaaattaggtaagacaggatcaaatgtaataacaaggattatggggttattgctaatgtctttaggtgtagaaattatcactaccggcttaaaaaatataggcgttttttagcttcaaagtcatattatccagtaaaaaatacaccgcacttttttatgctaaacattgttttttttcagtataataaaaaacattttttcacaacaatgatggaacaataattatgataaatacaaaatttaatgtaaaaacctttcaggggatgattcttgccttgcaagatttttgggcaagcaaaggttgttccgtagttcagccttttgatatggaagtaggtgcggggacatcgcatccaatgacttgtttacgtgctttgggacctgagccgatggcatttgcctatgtacaaccctcccgacgtccaactgacggtcgttatggtgaaaacccgaaccgtttacagcattattatcaattccaagtggtgatcaaaccctctccggataacattcaagaactttatttagacagcttaaaaatgctcggtttcgatccaacccaaaatgacattcgttttgtagaagataactgggaaaatccaacacttggtgcatggggtttgggctgggaagtatggctgaacggaatggaagtgacacaattcacctacttccaacaggtcggaggcttggaatgtaaaccggtaactggtgaaataacctatggcttagagcgtttggcgatgtatattcaaggtgtggacagtgtatatgatttggtatggtctgacggtgaatttggcaaaactacttatggcgatgtattccatcaaaacgaagtagagcagtctacctataatttcgaatatgcagatgtaaatttcttgttccattgtttcgaacagtacgaaaaagaagctcaatacctaattgatttggaaaaacctcttcctcttcctgcttacgagcgtattttgaaagcggctcatagttttaatctacttgatgcacgcaaagcgatctccgttactgaacgtcaacgctatatcttacgcattcgtgccttaaccaaaggtgtggcggaagcctattatgccagtcgtgaagcattaggatttccggggtgtaaaaaataatgacaaaaccgattttatattttgcccactggtgccctgacaccgaaccgtttgtcgctgaactagaacgcttgggtgtggaatttgaagagtgcgacatcacaaagtgtggtgcaaatcttaaactttttttacgtcttcgtgactaccacccagcctttaatcacgccaaagccaaaggctatataggtattccggcattgttgttagaaggggataaagtggtgttggatttggcagaattagaagggatttnnnnnnnnnnnnnnnnnnnnnnnnnnnnnnnnnnnnnnnnnnnnnnnnnnnnnnnnnnnnnnnnnnnnnnnnnnnnnnnnnaatcaaggagaaaaaatgaaatatgcctttatcgactatgaaaacctgaattcattagatggtttagcattacaagagtatgatcgaatttttctctttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatattttatccaatgatcagggctatgatggtatttgtaactttattcaacataaaaaacaggggcggatttgtcatggaacaaacggcaactagaaattttccagtaagattggaaagcttaaaaaacaatattcgtagccgttgcggtttaaataatattgatataaaagaggctgaaaaattggttgttctagtaattgataaattgctttcagaaaaagtaataaaaattgctgataacaaagtaagctatcctaagcgatagcaaagagtgaatttttattatttatgccactttcttttaagcagaaagtggctaaaaatttaaatactcggattgaatttttctatcaaaatgtgagctgacattctgtattacatgaagatctacatcataattaaaccaagtttattattttgtcatgtcgttaggaaaatgatgatgagcgtaaactggcaaaagcaatatccgccgcttgtaaagtgcggtcaatatctgcgtcagtgtgtgctaatgacatgaaacctgcttcaaatgcagatggtgcaagataaacaccttgttctaacattttgtggaaaaatagattaaacttttcaacatcacattgaattgcttgttggtaagaggtaacttcattttgtgtggtaaagaagatgccaaacattccgcctacataattgactacaagcgggatattatgttgatttgctaagttttttaaacctaatgccaatttttttgtgagcattgctaaacgttgttcattaccttcttttctcaattcatttaagcatgcgattccggcagacatagcaattggatttcctgataatgttcctgcttgatatacgggacctgtaggtgcaatatattgcataatttcttttttgcctccaaaagcaccaacgggcatacctcctccaatgacttttcctaatgttgttagatcaggtgtcacttcatagtaagattgtgcaccgcctaaggctacacgaaatcctgtcatgacctcatcaataataaatagagaaccatattcattgcaaagttgacgcaagccttgtaaaaaatcctgtttcggaaggatgcagttcatgttacctgcaacaggctcaacgataacgcaggcgatttgatcaggatattgttcaaaagcatttttgacagattgaagattattatattcgcaagtgatggtatgtttagcaaagtcttccggaacaccgggagagcttggttgtcccaaagtcaaagatccggagccggctttgacaagcaaactatccgagtgaccatgataacagccttcaaattttaaaattttatctcttttagtatagcctctagccaaacgaatagctgacatagttgcctctgttcccgaattgaccattctcaccatttcaattgatgggactaattgacaaattagttccgcaagttcaatttcaagcggtgtaggtgttccaaaacttagcccattttctgctatttttagtaccgcacttaagattgatgggtggttatgacctaaaatcattggtccccaagaacctacgtagtcaagatattgttttccttctatatcgaaaatatacgcaccgttggctttttctatgaacactggcgttccgcccacacctttaaatgctctaactggagagtttactccgcctggaataacttgttgtgcacgagagaataatgtcgctgaagttgtcatgataaatcctttaatatattgttaaaaacacactttgtattctactgtaaatgaagataaatttataaaaatatttataatacgaggtttttcgatgttcttttacattatttattatgcacccaattgctcaacaaattgaattagttggtaaacacattatcgtaagcatcataaaggtgcaattcttccttatttcgtaacgaattttgtcattccgttgggttaagagaatgaaaaaagaacgcagagaataaaatcatgaaatgtaatatcacttcataaattttattaaaaaaacgtcagtttggataaaaaattatctaataataaaaaaaagtaaaaaaatgctagacaagtaattgtgaaactcttaatatacgccccgcaacgacgcgatgagcgctcgtagctcagttggatagagcgttggcctccggagccaaaggtcgcaggttcaaatcctgtcgagcgtgccaggcgacgttatatcaaatgtggtggctatagctcagttggtagagccccggattgtgattccggttgtcgtgggttcaagtcccattagccaccccaattagtcggcgagtagcgcagcttggtagcgcaactggtttgggaccagtgggtcgtaggttcaaatcctatctcgccgaccatttttgttctttaacaaactatcagacaaactgtgtgggcacttgtgagactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttagaacgtcgtgagacagttcggtccctatctgccgtgggcgttggagaattgaggggggctgctcctagtacgagaggaccggagtggacgcatcactggtgtaccagttgtttcgccagaagcattgctgggtagctaaatgcgggagagataagtgctgaaagcatctaagcacgaaacttgccttaagatgagttctccctaacgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgaccccatgccgaactcagaagtgaaacgctgtaacgccgatggtagtgtggggattccccatgtgagagtagggcaccgccaagttttttatgagtttattttgttagtttatttatattagtaagctaacaaaacaagtttttttgcgactatagctcagttggttagagcaccaccttgacatggtgggggtcactggttcgagtccagctagtcgcaccaaatgaataaatcaatgtaacgcatagtaacgcatttcaacccaaaagccttgtataacaaggcttttttgctatccgattaacgctagttgcgtcaggataaatcacattgaccttgaataatagcacccattttagtacccacgcattataattagtttgattattgagtactaaaattatacaacctcttaaaaatacacaagtagaaaaggcaaagtatataacaggaaacagggcagaactaaacgactgtgaaggcttatttttacagctatacccatccgtctcaaaaatttggcgatttcgctataatcaccctgtaacacaaaaaagaacaaagctaaccataggtaactaccctgatttttctattgctcaagcaagagcaaaaagagaagagtttaaagcattattagcataatacatagatccacaggcatataacgagcaacatagaacagagcaagaacagagcaaaaaaaggacgcttttagcaattgccgagtaatggaaagataaaagcgtgaaagagatagaacctctaacaatggctaaaaattgggagcgattaaataatcattggggctgtattagatcagccctaaattccacaccattttcgcaatgtttttaactgctcttttggtgttccaaagttaaaccgaaattcacattccttcaagaacaaaggaaagttttttcggtcaattccattatattttcggagtatccgtttggcttgactccaaaagttttctataccgttgatgtgattttctttcactgcaaacaactccgaatgattgatgcgttcgtggtgaaattggctcacatcaagagcatcatagctacgatatgtatcggtataaacccaactgtcaggcttgattttccttgtgattacaggcattatcgtttcggttttggtattttctaccaccaccgtaaatacctttccctgtcgttttaacaagccaaaaacagccactttaccggttgctccacgccctcgttttcctttacgatgaccaccaaaatagctttcatcaagctcaatctgtccatcaaaaacatcatcggcttcaagggctaaatgatagctgatgacttcacgaattttacgataaaacaaggcacttgaatttggattgatacctaaaatattagctgctgatcgagctgtcacttctaacacaaaaaactcaaggagctttttctgtatagatttctttaatttacaatgagttattttcatttttatagactagcatacttactaatctaatacagcccctaatcatttatttcctcatttgggggcttactcaatagagaatattacccccccttttttttttactaattaatgctgtcaagcctctttacgagcaaggtaaaaatggcactatgcaccgcattataaatttagttaatcaagtattaaattacgctgttaatttgggtgttttatcatttaatccttgcctacaagctagcaaagcatatcacaaagaaccaccaaaaaaatcaccctgctattcattattctgaacttcccctattattggctgattttgaacaatctaacagagagctattaactaaatttttatttaggtggtaattgttatcaatggtacgccctgctgccgaagctgtttcagtggaatggagtgaaattgatttaaataaaaaatttggtttattatttctaaagaaaaaatgaagaaggttagaacggggagattttcgcattctgtacccttatcaagacaaatgataaaatattttagagcaattgaaaccaataacgggacatcataaatatgtatttccatcattcacaaaacctaatcaaacaatgagtaaagacacaattgctaatgcgttgcgtgaaataggctatcaaggtaaacaagacgcccacggattaaggacgattgcaagaacttatttagaagacaatatgattgattttagacttgctgaaagttgtttagctcacaagataggggataaggttagtcaggtctataaccgtgctgactacatcgaacagcgtcgcccaattatgcaactttgggggtatgtgcaccagaattttttaatcaatcaaattgacagtaaaacctagaaaaatcaatgtttctaggttttttatttatcaatatcatatgaatatcgattcattctacttattttggcaatactaacgaggatgatatagtagttgtggtcagtcctctgagtaaagctgagtaaaggcaaaatatgaattattttcatagtcttggcaaaaaatctcatttttcttaaaaaatttttatggtttaatacaccattattctaaaaatgagaaaaattaatatgatgacaacatttgaatgccgtgtacatacgcttgaatttgatgaaaattaccaaccagaaatgcagagtacccgtttaacgaccaactttgctaaccttgcgcgtggcgaaaaccgcaaagaaaatttgcaaaatgtcattgcaatgattgataagcgttttaacgatttggcaaactgggataatccaactaatgatcgttattctgtgaagttagagatcgtgtcaatagatattgatatggagggaaaaggtaaattttttccagcactcgaatggctgaaaacctatgtcatcgaccataaaactggcaaaaaaattgatggtatcgtaggcaacaatttttcgtctttcgtgcgtgactatgatttcagcgtgttgttgttagagcataacagaaacaaggaagaatttaccgtaccgaaaggctatggtgaattgcatggcaagctattcaaacatctgttaacttcctctgcatataaagaaaaatatagtaagcctccggtgatttgtttaagtgttgcaactactcgtacttaccgcagaaccacaaatgttcatccgattttaggggtggaatatcatcaagataattattctttaactgatgagtattttgcgaaaatggggttatctgtgcgttattttatgccaccaaaatctgttgcaccttatgcgttttattttgatagtaattcagatttattgaatgattacaccaatcttgaattgattagtacaattgctacaatggaagctttccagaaaatctaccgtccagaaatttacaatgctaattctgtggctggtcaagtgtataaaggtagcttgacttatcaagattactctgtgaccaaagtagaatatgatcgtgttgagcgtacacagcttgcaatcaaacaaggtaaatatactgaagcacattttattaagccatataaagcaattttagatgcttggatggctgaaaaataaatcaagacagtatttttatttgatacattcgtagggtgggttaaattccgcccctacacatttatttaggaaaaccaaaatgagcaaaattcttctcccaacctctacagccggtagtcttccaaaaccggtgtggcttgctgaacctgaaaaactttggtctgaatggaaatatcagggcgatgaactttttcaagctaaaagagatgcactattagtttcccttgctgaacaagttgcagcagggattgatattatcagcgatggtgaacaaactcgtcagcactttgtgactacatttattgagcatttagagggcgtagatttcaataagcgtaaaacagtgcgtatccgtaaccgctatgatgcaaacgtaccaagcgtaattggtgaagtttctcgtccaagctccgtatttgtagacgatgcaaaattcttacgcaagcatactgataagccgattaaatgggcattacccggtccaatgacaatgatagatacattatatgatgcacattacaaaagtcgtgaaaagttagcatgggaatttgccaaaattttaaatgaagaagcgaaagagctggaagcagcaggtgtagacattattcagtttgacgaacccgcgttcaatgtattctttgacgaattgaatgattggggcgtggcagcattggaacgtgcagcggaaggattaaaatgtgaaactgcggtgcatatttgttacggttatggaattaaagcaaatactgattggaaacagactctcggcagtgaatggcgacaatatgaagaaagcttcccgaaattgcaacaatcgaaaattgacattatttctttagagtgccaaaattcttgtgtacctatggaactgattgagctggtgagaggtaaaaaagtgatgcttggtgcgattgatgtagcaaccaatatcatagaaacacctgaacaagtagcggatattttgcgtaaagcactacaatttgtagacgcaaaaaatctttatccttgtactaactgcggtatggcaccgctctcacgtcaagttgcaaacagcaagctcaatgcgttaagtcaaggtgcggcaattattcgagcagaattagcaggttaatctgatatggtagaagtctctcaatttaaagatgcaatggcacaacttgcctcagcagttcatattgtgaccacaagtggtgaaacagggcagcatggctttacagcatcagccgtttgtagcgtgaccgattcaccgccaacattgcttgtgtgtgtcaatagcaatgcacgtgcctatgagcattttataaaaaatagggtgctaatggtgaatactttgactgccgaacaatcttctttatcaaatgtattcgcctcacccttaagtcaagaagagcgatttgctaatgcttattggacaacattggttacaggctcaccgatgttacaggatgcactgattaattttgattgcgaaattacagatattaagcaagtcggtactcacagtattttgatttgtaaaattgtagctattaaacaaggtgataagaaagaagcgttggtatatcacaatcgttcttaccgcattcttaaatgaaatttgtaaataaatcgtaagtcttataccgtaacttataagtcgataagttacggtgttaatttgaaaaaatcgctatgattttattaactttcttagaaaatatttgaaacgattgtatgtacgtctataaagtaattgttctcttttttgatgtttaaccaatagttgactgttatgtagttctttttctaatagagctagtgagaagagttggtaactttgttctaaatattgcattgcttccaatttatattgccttcttctatttaacttgaaatcagacaatgtagtattcggcatttgagtataagataatattttatgtaaagggatgagttctaaattgaataaaaatgagatagtttttggcaaataaacagaatgtttattttgttgtaactcatagttaccaatcccaaaatctgctttcataaattttaagtggtaataggcgaaaatattttttctaatatttctttgactaatgtctaaaaattctgtttccttgttttttttaaagatgctatcttcatctactctaaataaacatagatcaccatataatccacaataaggtgagctgtaagaaatataaagttcaccacaatgatcaataatattaattcctgaaacaggtaatacatcattgggataattttcttttaagtctaggtaagtctgttttagcaacggtattttttctgcagaaagaattaaatctccgtctatttttatagcccatttcttcgtagtttgacttaatgaaaagttatagtaattaatcagactatgaggattatcaggttctaaatttttatagttatcactaccttgaggataaacaacaggtaaatagtgaaaagtttttattttattaggataaagttttgcgtattgttcagcaatttcacccgtattgtcttggcaattattatagacaatcaccaattcatctaataaaggaagccagctttcaatagattgagcaagaaactctccttcattacgtaatcgcataaaaccgcttaagccttcagaacgagtgttggcttgaaaacgtgaaaaatcaatggtaggatttttgactgactgactgactgactgactgactgactgactgactgactgactgactgactgactgactgactgactgactgactgactgactgactgactgactgactgactgactgatttagcatattgttatttcccgtctttttagagagaaaaatggtggagaatttccaccatttttcaatattattcacttctagtgactttaatcgccaactcttccaaagctttttcattagcaagactcggtgcgtcagtcattaaacaagctgcggctgttgttttcgggaatgcgataacatcacgaatattatctgttccggttaacaacatcgttaaacgatctaagccgaatgctaaacctgcatgtggaggcgtgccgaattttaaggcatcaagcaagaatccaaatttctcacgctgttgatcttcatcaatgcctaaaatatgaaatacagtttgttgcatttttggatcgaaaatacgcactgagccaccacctacttcataaccattaatgaccatatcataggcgtttgccaccgcacttgtcggatttgcttctaattgctccggtgtgaaatcttttggactagtgaacggatggtgcattgcagctaaattaccttcttcatcacgttcaaacattgggaaatcaataacccaaagaggtttccactcatctaagtgagttaaacctaaatcacgacctagtttcaatcgtaacgctcccattgcgtcagtagcggtttgccatttgtccgctccaaagaacaaaatatcaccgctttgggcagaagtgcggtcaaaaattgctttgattttttctgtcgttaagaattttccaattggactttgtatgccttctaatccagcgttgatgtcattaatttttacccaagctaaccctttcgcaccgtaaataccgacaaattgagtatattcgtcaatttgttttcgagtgatatttataccgtttggtacacggatgacagccacacgaccgtgcgagctatttgcagggtcgctgaaaacgttgaaatctatatctttcacaatatcagctacatcgactatttctaatggattacgtaaatccggtttatctgaaccaaagcgttccattgcctcttgccaagtcattgtcggaaatttgcttaaatcaacgcctatggtatttagccataaaccatgcaccattttttccataatttcacgcacttccggtgcagtcataaaggaagtttccacatcaatttgagtaaattccggctgacgatctgcacgcaaatcttcatcacggaaacacttcacaatttggtaatagcgatcaaaaccggacatcatcaatagttgcttaaacaactgtggtgattgcggcaaagcataaaacttgcctttatgtactcgacttggaactaaatagtctcgtgcaccttcaggcgtagccttggtaagcattggggtttcaatgtctaaaaaaccgttttcatccatataacgacgtacaaaagcggtaattttggcacgggtttttaaatgttgagccatttcaggacgacgcaaatcaagataacgatattttaaacgctgttcttctgtattattctgattaaaatctaaaggaagtacatccgaaacgttataaacagacaatgctttagctacaacttccacctcgcccgtcgccatatttttattaatttgattatccggacgagcaataacctcaccttcgattttaatacaaaattcattacgcaatgcactggcttccgtcaatgcttcttgatatttcggatcaaaacaaacttgtacaataccttcacgatcacgcatatcaataaaaattaaaccgcctagatcacgacgtttatgaacccatccgcttaatattacttgttgtccaatatggctacggttcaatgcaccgcagtaatgagaacgcatcataatgacttcctttatatctgaaactactgaaattagtcgacgaattatagctgaaatctcgctcatattgaaagagtggacggaatttatttgagtgagacttaaacttcttctaaaatgaccgcacttttttacacttttttagatgaaccataaaataatgaataaagattgtatttttgctgcacccattgaaaaactgggagattttacttttgatgaaaatgtcgctgaagtattccctgatatgatacagcgttctgtccccggatattccaatatcattactgccatcggcatgtttgccgaacggtttgtgacggctaactcgctagtgtatgatctggggtgttctcgtggtgcagccacgttatctgctcgtcgccatatcactcagcctaatgtaaaaattatcggcgtggataattcattaccgatggtagaacgttgtcgtcaacatattaacgcttatcagagtgatattcccgttgaaattttgtgtgatgatattcgtaatattaaaattgaaaatgcatcaatggttattttaaatttcacattacaatttgtaccgcaacaagatcgtcaattattactggaaaaaatatatcagggacttaatcctaacggaggattggttttatcggaaaaatttcgttttgaaaataaaaaaatggacgacttgcttattgatttacaccatcaattcaagcgagccaatggttacagtgaattagaagtaagtcaaaaacgcaccgcacttgagaatgtgatgagaacggatagtatagaaacacataaagaacgcttaaagtcagcaggtttctcccaaatagaactttggtttcaatgttttaattttggctctatggtggcgataaaataacaaaaaaacagcctctgaagtaagaggctgactaagtttaactatgactttcataagcgagtagcgtattaaacataagcatcgcaacagtcatcggaccaacacctcccggaactggagtaatgaaactcgcctttttgctcgcttcatcatattgcacgtcaccgactaacttgccatcaactcggttaattccaacatcaataacaattgcaccttctttaatccattccccagggataatgtgtggcttacctactgcaacaactagaatatccgcttggtgcacatgacttttcaaatctttagtaaaacgatgagtaactgtaactgtacagccggctaacagtaattccagtgccatagggcgaccaacaatatttgatgctcctataataacagcatgttgtccgtacagatcaacgcctgtggtttccagtaatttcattatgcccaaaggcgtacaagcacgtaaggttggaatacgctgacaaagacgcccaacattatacggatgaaaaccatcgacatcttttgttggggaaatatgttcaatcactttagtagaattaattttctctggtaatggcaattgcaccaaaataccatcaatttgcggatcttgattgagttgttcgatgagagttaataattcttgttcggttgtttctgccggtaaatcataagattttgaatagataccgagttcctcacaacttctacgtttacttcccacataaacctgagaggcaggatcagcaccaactaaaataacagctagtcctggtgctcttttcccttgttgaagataatgctgaattttttcagcaacattaaatttaatgtttttagagagttcagtacctgaaataatttgtgcgggcattaattctttccttcaaatttgatctcaaatgagcaacataacaatcatttaaattattgaacatgaaaaacgctgctattgtgtcaaaaaaaagcgagaaatgtaagtcaatttgagagaaatttcatcaatcaaataaaaaagtgaaaaagtaattgactgtttatgaaagaaaattataatgcacctcatcggcgagtagcgcagcttggtagcgcaactggtttgggaccagtgggtcgtaggttcaaatcctatctcgccgaccatttttatatttattattttttatatgcgcccttagctcagctggatagagcaacggccttctaagccgtaggtcattggttcgaatccaatagggcgtgccatttaaatccttatatatcaagcagttatcactcaggcaataagttttaaatgtgtcacagatttgctctgtgccgtaaatgtgccattaaattcaaccttgtttgcgtgctctagcagatgatctgcatttaagtgagcgtatttttttaccatttcaagcgtttcccatccacctaattctttaagtgtgaagagaggagtgcctgcctgaacgtgccaactcgcccaagtatgacggagatcgtgaaagtgaaaatcaagcaaaaaacattttctagctgctgcattaaatgctttgcggttaatgtcatttagcttattattctcacgcccaacaaacacatattttgcgtgtttgccacgtaatgacttaagcaataagattgcttcgtcgcttaggagtagtgatcgtgctttacctgattttgcaacatcattagtcacgatcgctaccttacgcacaaagtctattttatcccaagtcattgtcagtatttccgtcctgcgagcacctgtcattaatgcaaacgcacaaatggctctcatccaatcactatttagcttggcaagtaagtcttttgcttgctcttttgtgatccatctaaccctaataggcggttctgcatttttgggtaggtgtgggactttgtcgaccaacccagcctgatgagcaagatttaagatccgtaaaatagactgtatatacttgtttttggttgagttggtgagcggtttgtttgtgttcatattccgtgtagggatatgatttaggatttcttgagttgttaaagagctaagcacccgtccttggaatttctcacgccaatatttagcgtgtcgtttttttgtgcttgtatcttttagaccttctgcagagcgtacatacagtagtaacgcctcttcaaaaatatattctggcttttcgttaagcctatctattttccacgtttctgctttaagctgatcgtggtaatgttgagcttccttttttacagttgtgccagcagagcgtctaattctcttaccgcttggggttgtgatatcaacccaccatgggccatcttttgttcttctgtagatcgacatagtgttacctcttcgaccgacaaagctaatcggtcgctattatttgctcgttttttgagtaaatcaagatctgatttatggataagccaacgattagatcctttcattctaaaaaatccccagtcatagagatgatttctaaccgcactttgactaaggtttaagtgtttcgcgacttgttttatwgtkagwgyttcytccatatttcctccaaaaaataaaccctagcggtggctakggttgttttaaataatctactagtcgctccccaatccatcgcattacagggactgccattgagttaccgatagctttataacgtggactatyggggcaatcatcaatckgtttgttgcgatatgggattagtgtccaattatcaggaaaaccctgcaatctctcgcattcggttggagtgagcttgcgaataatagatggttggcaaatgcaaggtacattatttccacctgtcccmwttcttgcttttaatgttggtgatattggtttatctgcaattcgcacagcctcttcgcctttgacttcgaataacaccttatactgtgatgcagtcattgtaggtgcgataccaattcctacagtgtgctccttgtctttgcagattattggtggatacgctccataagagcattcaccaatatttttggcagaacttttcccctcttcttggctctgattaaaatcccctcgcaagctcttttgctcaaaaagtatttgtgcgacacttcgccttctagcacttgccacaaggaacactcttttacgtcgttgggcaacgccgaagtattgagcattgaggactcgccaacagatagtacgggctgaatgcacataaccagagtttgtccatcttgcccctgaaggttgtaatggctgacattcttgagccagtccagccaaaaagtgtccgaatgcgttgtccttggtagataagacaccttgtacattttcccagacgagcacgcaaggcggttgtccattttgatttctgacataatctattgcctctaaaatatggattaaagctaaagttaaatttcctctctcgtcatcaaggctttctcgcttgcccgcaaccgaaaatgcttggcaaggtgtacccccaactaacacgtcaggggctttgatttcacgatttaggattttttcaggcaaggcggtcatatcgcctagatttgggatttcagggtatcgataagcaagtaaagcggacgggaaaggttcaatttcagcaaaccataaagrcttgcctaagccttgccacgccacacttgctgcttcaattcctgaacaaattgagccgtaggtgaacattgttactccaataaaaagccctcaaaattgagggcgttgtgtggttattcagtttcggayggtagcggtgggatttccgcaaatttatcaatttrttctaattcgaaagtggcattaaattcaggtatgaccyagacatatacatattcattccytaattcatcacagyaatytggttctctccttggtttacgytctgcgtctatgaatgttagatacccaattattttrgtattatctaaatgtggtatatttacataaacaggttgattgagttgaggcaatgagtttcttacactaatccatttactcatttttaacatccttaggcggttgtgggagtggttgccartgrgtaayttcaaaaagtttactactcatattaaattctccatcaacaagttctgacaaagtaatagatttatagtctcggcttgcatttttgaaatatacaagcactctttcgcctgattttggtagtttatctttaacactaatccaaccgttaatctctaagatttcaggtgagttgataatttcatcaatctcatcgtaatatcctgactccttttcctctttagttaatggtctcttacttgagattgcttttcccaaaataacaccataaactgcaaatggtaggtaatatccttcataattttcaaattcatccaaatcgttcgcaaaatcgtaggcatcaacagcactgtttaaacaactctgttttgcttgttccagcgtttcgtgcaactcaaccgaatgaatatcgtttgatacatcaatcgaaaagtattttttattattcatattattctccttagtggtgttattgattaatctgtaatcttaatttcacgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattaccgaacacatagacctcgccactcacttgagcgtagcctctcaccttagcgttctctgttatccacgcacagtcgcctataatagcgtcttcatagacttctgcgttatctcgtacgtaggtgtcatcacgtacaaccgcgttgccatataccaaagccttgtcacataccacggcgttaccatgtattctagcgttaccgaatactctcgcattgccatacacctccgcattgtcatacacccaagcatttccatcatgacttagattttcttctttctcaatataaccgcccagcttacccgcctttatatcaccaaaagagattaatgctttaattcggtagagtgttttaccattctgttgaatagtatcattttgaagaagttcgtattttttttgaacttgtctttcatattaaatttccttgtttgttaacgtcgtttgtcggattaattttttcaatcaactcatttccgaaataagctgatcgtagtatttttgtgcggcacttacgcgttcaatgaggctagaatagtcgcatagagagtgtttttttcattattccacaaacgtcattcttttgtagatttctcttactcgttcaacatcttttgcacaatattgagctacttcgttgattttgccgtcttggatgtattgccatacttttgatccgtcaatatcgcctttttgttcaatatcaagtactttgcataatttgtcgagggaaacagtgtttccataacctgcccattcggtcatggtgtcatagatattgtgacgaagtggggtgtagcaaggtttgatacggttgatcacagagcgttgaaagataaagcgaccatcaaatttagtaatgttatgtccgatcataagtggtgtagctttagtgatatgtttgcgtaaccagtcgttaaattgagttaaaatgcgagtttcccgatctggtaattgccaatcttcgcaatagaacaaaacaggtgaagtgtcatcaactgctgcaccgataactacaatttcaccaaatgcaccatcaagagcggtcttgttgacgacttcgggtttattttctgctaaccatttttcaattgtttcagggtttttgtagttagcaggggctttgagattttcacaaacatagtttttgatttcgttgttttgtgttgggattgtttcaatgtctaaatagattttcattttgttgctccttgttagttttttttgattttagtttgcgtaaaaatcggttgatgttatcgcaagttttaaattgagaatgtggactgaatacaccgtgttttgggttttcccattctggttgtttgtcaacatctagcattattaacctctcattgtttgtttccagtaatcactatcatcattctctgctttcgcataaaaaattgtgccttgatcactttttctatagcttgttgtcttgtttcgataatatccatcatcgcaccgctcccaagtgcgatatggtaatcttcgctattgtctaactcatcataaaattggctgtaaatttggctgtttggatcttgtagttccatcaaaacttcggtacgcactcgtttaaattccaaactatcctcaatgtcttcaccaaaatatgcttctgccatatggtcaaaatgtctatctaccgcttggattaattgcatatcgttcattttttctttccttttaaaagtagcgtttttaatttttcaatagaggctaagtcaaaggttaatacgctgtgatgtcttgtttggcgatctaacttaatagataaattaccctcttcatcaaattgacaatgttgaaccttgtgtattgttttacctcgctcgctcttgattaccgcacttaaccttggatttttccattcaatagccagaacgccctgtttctcctgaagcataggtagtttctttatcccttttaattcttttgtcatattgatgatgtcgattgctttgtttgtcgctttaatggcgatgatttcgctcaccatcggattgcaagtgcggtactctctcacatcatctacccaaacttccccataaaattttttactgattggattttgtaaaatttggattttgtagctattcatcttcatttcccctccttgtcatactgtgcttgtagttgttcggtgtatttttgcatgtagtctacatcggcttgggtaggcggtggcggtatatcgcccttgcgtgaaatccattcaattcttgccatttcttcatcgtaagcaagctgtgcttcgggggagagttttccatattgagcaaacgctgggtgaaaataggcaaagacaagtagagtgctaagaaaaatagccacgataagaacgataaagccaagccatctgtaaaatgagattaataaattattcattttttgtttcctttttggtcaatttactgaatttaggttgagtgaaaccgccacactggaaaagtgcggtcggtttcctttgaggtttaaaatcttggcaatgccaaaggattatgtgttgctaatatttcttcgcctttttgtagccacggattaaactcatgagcaacgtcataagacaatgctccaatatcgtttcgaatgtggcgttcaagtccgagcattaaaaagagttgacgatgaaagatttctgtttgttcagcaagctttttagctagtcgagtatgtttcataatcgcttcgaataactcggcggaaatggtaatttcgtctctatctgcgattttaggcggtgtaataatcagctcgccctctaaacaaattttgtgaacatattcgaccgcactttgtaatttatctgccggtatatcctcaatactttctacgttcatataatgatgaacaagattgtaggcttcgttgtagagtaaaccttttttgctgacgagcatattgacggcattacgtaatcctgtgcggtcatcaacggtggttttgcgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagattttatttgtattaaacaagccactttcgacagtggcgtcaagaggttcgaaagcctaatctaaggtaagggctgggattatttcctttcggtattgtattctccgccctctcgacatnnnnnnnnnnnnnnnnnnnnnnnnnnnnnnnnnnnnnnnnnnnnnnnnnnnnnnnnnnnnnnnnnnaggtttcgacacctatgggggaatagtaggttaaatttcttcgtttgtcaatagataaaaatgtaatatttattacaaaaagtacttgcgttaaaatgtaagtagtactacaataaacatatctaaggcaaggtgctttagatacaagaaaaccccgacttgttgggttcggggcattcaaaatggagtttaggatatgttgttcaaagcgttaatcctaattatcctcttaatggtggcaatgccagcgttctaggataatccatcgggggagggcattcccccgatgactccaatcttaagctaacttaacccaaaatgcaaggagttttctatggcaatgacaagagctgaaatcaatgcaaaaagcgataaaaagcgtggtgtgcggtttcagtcttataaacttcacgaagatgtgattgcattgcttgccgagctttccagccaaacagggttgtctaaaacccaaattgtgacgcaaggaattatgctgtttgccgaaacaaaaaaggtcgcataacgtgcgaccaatcccgactttcgtttgaaagtgggaatatcctaaatgattgggcggtggtttgtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcggttatcttaatccgaagtggggcggttgtaaagtaaaattattttgagatagtgtactattttcttgtgttatagtgtactatcttttataataggcgacatcagcacggggctgataacaggacaaagccccacctgttgagatggggctgataacttggagttaagacaagatgaaaaccttacaaatcatcttaatcttgattgtgctgttgttagtaagttcaccagcttactaagcacttaaaaccgatgggggagttcgcacctccccctgaggtctccaacattttaccaaagatagatcctgaaattcaacctaaaatttacttggggctaaacctatgactatgactaacgctgaaaaagttgcccgttccgatgccaagcgtggcattatggctaaaacctataaactgcctcagtcggttgtcgctgaaattgagcagttgagtgagcaatatggtattccacaaaatcaattattgatacaggcaatcgaagcgtttaaacaggcaaaaggggcgtaagcccttttttgctagtcgccgttccaacgcttctaatctgcatactgttttgttgaacttttagtcaaaattgtttccaacattaacacattgacttttatgtttaaatttagtatagtttaaaatctgtatatatgtacagtgtttttttaatgttatttttaaaaggagaacgcatatgtctggatttgttgatttaactttagagtctggtgcaagtattactgttagtaaaacggcagttttttatcttcaagaaagtaaaaattcccctcaaactacgttattacactgcggtggaagcgtaacacatcaagtgaaaggaggttatgaagaaattagcgttaaattccctaattttattcaaactgagctttctgatggggtgaaagttggcattcatgattacaatgtatcttgcttggaagaaaagcaaaacggtattcaagtacatggtgtagcagtttattttactagcggtcctattgggttggatgtaaaagaaaattactcagactttaagaagaaatttcatcaaatttaattcatatttaaccgcctgtttgggcggttttttgttggttttatgccgcacttttggttaaagtgcggtcaattttagctaaatttagatgtatatatatctcaaaaaggaatttcatcatcaaggttatctgctaatgggggcggataagatgatgaggttgattgcccataaagttgttggtgggcttgataattttgttgttgatcttgttttttgcggtcgtctttatctttaatgtgttcaataagccatttaatccgttcagctggtttattttcaagatgctctgccaaggttttttgggtgttgtggaagaatgggcagagaatctgaaagccgtaagtgtctgaaccgtcttgtttggtgcgaaggactttttgcagcattaatccaatatatttgccctctaattgtggtgcgtacgctttgttgtctttaaattgtcgtgtaagttcagccactctcgtgacccccataattgcttgtatcatgttgtgtccgctttgtagtgggctaccgtctttaccttgataatagattgagaggtaatttcctcttaagccatcttttgtttcaacagtcagttcaagggataatgcaccactttgagactgaacatattctgcactgataattctgcaaatatatgctcctgtttcagcgataaaactggaattaccagctttgatcgcttgttcttgattgtaagtgaatattgtttgtgtcatttttcgtttccttgtgttggtttgatgtcgtagtaatcgcaaatcatttcatcaacggcgttgaggtcgttttcaatgaattgcgtttcaaataatcccatagggctttttactgggtcgttaccgttgttttgcgtagagaattggaatttccagtcatttacttgtgtgcgtaaacagatagtaaccatgccttctagcgtaattttttcatcaagcattttgccaatggttttgattttggttttgccaaatggatcggtttcgacgtgcgataaaatatagatccgcttgttcattggtagctttaatgcggtattaaataccgtccatgctttttcgccaatgtcagtaaatttgtcatagcctctttctttcgcacgtcgcataaattcatttgccataatgtattgataatcatcaatgataatgatttcacgcggtgttctagtcatagccttgcaaatagtttcagtatcatcacagacaaaaatagatccgctagggttatctcttgtaatgggttgccattctttcgccctaaatggaagtggtttgctaattgactggataagaagtgttttttgtgggtcgaggtggcgtaggctagttgatttgcccgaaccgctttcccctaaaattaaggttgttatgctcataatattcccctaaaaaaaaccgcactttaagtgcggtggattttgatgaagtttagttgttgattaaagtatcttgtatcgttgtagtcttcgtttttggttagagtgttgagttttgtttttattttttacttctaacagtttgtcaattaatggaagcgtgtctttaatcgctttttttgtccaattcaaattcaattctacagagttgaaaatatcgcttatgataatcggtttgatttttttaagtaagaattcaacgctttcagcaaagcgagtgaataacatccatacatcgatcatcttttttagttcactttcagttagttctaaagtgaatttgggttcaggcattggtaatttaagttgtgttgtttggttttccagttggtttaaaaacgcacgcaaaaccacaagatgaaattgtggcgaaatccacgcagcgtaggcgatgacgatttctttgcaggcgtatgtgccaatgccatttttgacaattaaaactgagctgtgagatttctcacaggttggattttcgctttcaatctctgcaattagagcttttgtttgatcatttcgcaaaaaataagtaggacgatgttttggatcgtttccacttgccctatgaagatctgctaatgaataaagattatttaaagtacgaattgagttattaagaattgctaaattagtcattttgactgctcctattggttttctgaaattgaccagttctgacactggtgccgagaggttcagaaccctccaataggttagggtggacgtattccccgaaggtattgtattagtcgccctctcgacgttgcgagatatcggcataaaaaaagatcgcttttggcgatctgcttactaccgcctattggaaaaaggttctgacaccttgaggcagatagtaagataaaagggtggggtttgtcaataaaaaagcctgtgttgtaaaccggctattttgttattttcttttttgttttctaggtttatcgtatttaatcatttcacgatttgcaccttttagtgttttcttcacttctttaatattctgttcaagttcaagatgttcaggtgcaatcccactattttttatcatcatatcccgaacttctttaccaacttgagaagcggtattttgtaatgcatttaaaccacgtacattcttacttttaattcgttctgctgtttgagttactctaaaccagttacctgcaagttcagtatttcccataaagtcatataaagtccctttttcatcaggcatctgtttatgacgtttaagttcagctaagcccatattatacataccacggaatcccgcatctttaaaaagtccaaagtgttctggtaaaagcccagcacctttcgcagaagctgacataatttgttctccatcagctaattttttacggatttctaaacgctgaatagcgttatcatcaatcgcattttggactaatttatctgcaacagcagccaagattgtttttgcttgagcaacttgttcttttttagaatctgcgtgcattgtgataagaaagcacgcaaaacgagagagtttataacttttcacctctctaccttgaaagacaatgtcaatctgcgagaagttatccattatgtcaatttcaaggttggcacaagacgacatcgctttattgataacgcttttgaatgagttccaagactcgtaaccaagatgtagcataaaatcgtgggcgtgccagtatctaatgccattttggtgagcatcattttcaaagagttctaaatcaaattgttctgccattgtttacccctgtaaaaaaagccgttattgaacggcttgtagtgcggtcatcttaatccgaattcggggcagtgtcaaataaaaagtttattttatataaaatatctcttgcatatcaattggtatattgtataatatacttgtttttgagatggttcaaaaatgagaagagcggctcaaaccgctcaactaatggagatagaaataatgaaaaccgtacttttcattatcatcttgttagtgttgttattggtaagtcctaacgtttactaaacactaacccggagggggaaaggtcagatgttcccccaatggctccaatcttaagctaacttcatataaaaggcaagcgttatggctcaaatttccgaacagttgcgtaagcgtaaaatagagacagcacgacgatttaacgataaagcccttgcagaaggtaaggcacggcgtattttaatgcaattatcagccgaggtagccgatgaatttgacgctatctgtgccgaattaggtatttcccgccctcaagcaatcaaggcattgtgcgagatgtatcgggcaaaaggggcgtaagcccttttttgttgtctaaaaaaagcccctatctctaggggcaaactcacattacggatttcatatattgattatgtcaaaagtaccgttttaaccactcggcgtgtggaatggtnnnnnnnnnnnnnnnnnnnnnnnnnnnnnnnnnnnnnnnnnnnnnnnnnnnnnnnnnnnnnnnnnnncgtgttgaatggttgcctttctttgacctgtaaggctcaggtgttgtcacgtttattttttaacgagtatatcggttactctcttgtgcctcactatgcacgcccagatttcgcctaaacctattattgggttatgtctttgtcttactaaagcgtaagcataacgctgtggcaagtggggggttttatgggcttcctcttgtgtttccactctgacttgcttcaccatcggrcaataataggttytatccaaattgtrtcgagatgaaatgaaagcmycttgkggatttttagartatratrgrtctaaccttgtgcytgctgatgatgttcckgaaaacgttccttaaaattgattttttcatcaaatggaatttcttcrcayagytcaccatcayaggtarcttgggacattgycttgattttttctttggcttmttcggcrttgttggcrtatacatyacagcaycaacttgtgccttgkarctgatagcgaaaaaggtattttttcattrttttttcttccwtaggtattccttatgmratttgaaacttacttagacaaacgccatgagtggcgttggcgtttaaaggcaagtaatggcaaaayaattgcagatagcggtgaaggctataagcaryrttytgactgtttrcatggrattgatttggtacgacaaaccaatcagttyacagakattatttgycttgragacgataaacattaaytccaaagctccgcaaggggctttyatttcatctcgatttttaamgagcgttccttrttacaggatttatttttgccatttccaaccgcacttgagattaggtcgatactctttcagtttcgtgcgataaatcgtcgttttatccatttttcaacggtcaaataagtgcggttggaaatggcatagttttggtttgatgaggttattatgtacctaacgttcattaaagtaaagaacaaaaagtacaaatttttaaattaatttatgtactttaagttattttattgatytrmaaagaaatttatttttgaaaaaaatgattgatygcttgwtttttgarcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagtttgaggtaaagaaaaaaccgccgaggggcggttttgttattgatgctcaataacatcaagaataattgcatctttaattttttcatcaagtattttggcattaatactcagtttaaccggttttctttcccattctgcttgcattagcaataatttgtttttattacccgctaaaaactgatcttgaacaatcgcctcaaatacagcctcagtgttcacgttgcgaattcgtactttaaaaagttctgggtctgaagagtttacttgttcaagtctataagttccatcaagtcttatttcggttgaacgacggcgtgcatttttagtaagctcagtcgttatttcaggatctaaaatactattacctatttcgacttctttcacaccaataaatgatttaaataaacacgtttttgcatcgtgagcctgacgatcaatattttctagaacagcattttgtttcacgatattagcaataatccctgctcgttttgtttcctcttgcgacattagttgtaaagattgaaggtgctctttatcttcatcttttttaatttcagcaaggcgaacttcttttctattatctaaaaatcgtttaattcctgagcttgttgcccaaatagcagcactaccaagcacagttattgcaagtgttgttgcatccatttttgtagccaattgccctatttgtatccataaaccatcaaaattaacattcaatagcgacgaaccacgctcaacagtaatttttaactgcaatgcctcacgttcttcttttgataatttctgcgtatcaacatcattatattgaattagacgataggttctattaatgtaattttgcatttctacaaagcctttcattatgtttggcgtgaggctttgctcaaacttttcacccactaagcgaatactcagtggaggtagtttttgtagatctatattatcactaattaaacctgtttcgatataatcctcaagaattttaaataatttatcttcagaattgataacaatattattcatttcatttaattccatattttaactccgttcttacaaacctataaattagatttctgctgtattcagtttccgcattgctgtggcacaagatttatctttcagtttgcaaccctacaaacagctcctatgctcaacggctttgccgattatttttattttatggtgtttactgcttaacgtgccgaaattgtcgttgagaggaacaagtttgaaatgttttctgccgtgttcgtctacttcgccagtttctttgtattgtttgaaagtggcttcgttatcttcgttgactgcgacaacaaaatcaccgggggcgggatagatttcgggatcgattaataccatatcgccttcttggaagcgtggtgacatagagttgccgacaatttttaaataaaaggcatttctaccggctttaatttgcgaggagatcatttcgtattgggtgatttcatctgtattactcagcaaatttacttcagtaaagtaacccgcttgtactgggctgagtagtggatagtaaaaggatttaacgacttctacaaatgttgcattcttatcaaaatttttgacatcaccaaaagttagccattcaggggtaacactaagaaaatcagctaatacataagtatttgcagtagatggcatggtttctgcattaaaccatttactcacagctttaggtgtcagttttaatatatctgcaatttgtttgccacgtcctttgtttggaagccctttgttcttacaggctaagtctaatctttccgcaaacgcttttctaatttcttcttcattcattcttttttcctctttgtactgttagttcaattataaaaaaaacttgaagtactttcagttatattttaatatgtacatttagttcagtataagaggtaaaatatgacatcactagtacatattcttgatttagcagggatgcctaaagttgcagaatactgtggggtttctctgcgagctgcctacaaatggcgtaaagccaatgccttaccaagaactgaatatacaggagaaacaaattatgccaatgcaatttctgaagcgattaatggtcaattttcttctgattttattcgtgaagttggcagacctaagcctgctgaaacctaatctaccccaagaggtatgcaaaggctcgcaaggaattaacaaaaaaatgcaagggcgattgcggatttgatttttcgcaaatctagcagtcgcactacaggaaaaataaaaagccactgttggmgcagtggcaakgattaggaaaaatcgctatgaatattaatcykaaygaaaaacaaagtcaatcgcagaatgcgaggattttagctcatytraaaaawggtgrgmgaatmacytcrcttgawgcrttaaatcaatttggctgtttgcgtctttctgctcgcattaaagatttrcgtgatygtggtcatgaaatccatgcrgaatttattgaagtgycwartrgyaarcgtgtgaaacagtattttatggaggcatttcatgagatttagtcaacacttacgacaattgggtcaacctattgcgtattatccaaaaatggcaaaacccttaggcggtgtgactgctgcgattttattttgtcagcttttctattggcaagataaaaccgacaatccgttaggcgtgtacaaaacacaagctgaacttgaacaagaaactggattaagtcgccgtgaacaggaaaccgcacgcaaaaaattagttgaattgggtcttttaatagaaactcacaaacgcttagaacatcgtatttattttaagctggatttagcgaaatttgacgacctaatggctaccatttttgaggtagaaaatccaacattacccgatggcgataatgtacaaccccgaatggcggaaagcgacattcgggaagtagcaaaaccgccattcgttaatacaaagactactacagagaatacaaacaataaaaaagatttaactaacgttaaatccaaaaaagccacaccaaaaccgaccgcacttgctttrcttgctgaatttggcattaccgatcagcttgctgaagattttattgaacagcgtaaagtcaagaaagcaccgattacccaaaccgttcttaaccgcttgcagaytcaagccgatattgccaaattgccacttgtggaggtagtggcgattatgattgaccgcaactggactggctttaatgccaattgggattggaggggcgaaagccaattttcaggtaaagccgagccatcaagcaagcctaaattcagcgatgaaaacaccacttggtggcaagggcgaaccattgaaatttatggagatacgctgtgaaaacctttgaaaatgcgaccgcacttattggcagtrasccgaattattctgcacccgtagcacaagggcaaaaacaggaaattcctgagcaagtagcgaagtatgttgaccgattatttgttcgtttaaaagccatttttccgggctggaaagcagcgtttaactctgatgcagagtacgaggaagcgaaggctacttggttgcaagcattggtgaataatgggattaccaaagcagaattatttaaacgtggtttgcagttagcagaacgctcagaaagtccatttttgccgagtgtcgggcaatttattkcttggtgtaaatcaggcaatgagtttgccgatgttggtttgcctagtccagaagagttgttgcaacgctatcacaaatttcgtgcgagttgtgaggagccggagaattatccttggcaaagtgcggcagaatttcacttagtttgtcagttaaaacgggcgatttatcaggagaatttaacccatgagaagttactgaacaaagctcaktcgttgattaaagccatggcaaaatatctcaaagaaggcggtcaattagcagcaccaaaggcaaaaaaattaaccgcaccgaaagagccgaatttaacrcctgatgaatgtacaaaatactttgcagagctacgyaarcarwtgystrgcrtkacaaaaacggtttagyaggagatgataaaatgmgtkttgamaaaraygcktaccgcacaccwcgttatgtttttaattggttagaacgtcgtttttattggtttcatttagacggytgtgcgaatgarcataatagcttacgtcatcgttggattggcgarggtagcwskgtkgcaacagattttttagcagatgatttgtttgatcgcttaattgatgaagtggttgaacaagcggaattattacggattttcgttaatccgccatacagtaatcctttgccgtttgtacaacgtgcggtwgagytgatgaaagcgggttaccttgttgttatgttgttaccggcggataaatcractaagtggtacaaagtcattcaggataatgcaacggaagttatcgatattatcggcggtcgaattaactttattcatcctgaaacaggtgaggaagtcaaaggcaataacaaaggctcaatggtggcagtgttcgatccgtttattcaaggatttgtaactcgtcaagtgagcttggattttgtgaragagtgcggtatttcatagtgagatttttcaatggctaaataccaaatgatgaaacttgcaggaggggtattttctccattgaatgatgctgaggctgaacgcttgaaatcttttcagaataacgagcaatatgaaattgaaattaaaagacagcgtaatccagcatttcatcgtaaggtgtttgcgttttttaatttctgttttgagcattggtgtggtgagcattccgattggaaatttcaagatgaaatagctcaatttgatacgtttcgcaagcatttaactgtattggcagggttttatgttaaaacgtggaatttaaagggtgaggtgcgtattgacgcacaaagtttgagttatgccaatatggagcaagaggaattcgagaaggtgtatcaggcgttgattaatgcggcaattaaacacgttttcaacaacactatagacgagaatgtgattaatcaattgtattcgttcttttaaaattaagatataaaaaaccgcactcgaaagtgcggtgggttttaagtaagtttagcaggctttcagtggcaagcggttttcctgtttgaggcttgccagcattcgtttaattgtcgggttggtttctttgatgttctgcttgcagaggttgtaattaaactgtgcggagcgttcttcaaagcggtcaaaatcgaacccgaaggctttaagcaggaaatacacgctttcttgaaaacgggtgaactgcatccacgtgttgatgaagttgcgtaattcgctttcggtgaagctgaacgtgattgagggttcaggttccggcaaggcaaactgtttcggttttagctgatatttccccgttttacggatttgcggtagcacttcttcaaagacccagttttgaaactcgaccgcttctggtttgtttgagcggaaaatcacacgataaagatttggctcattgataaagatcatttcctgatcaccacttgtggtaggggtggaaagtttttccaccccctgcggattgaatttaaatttgcttacagagcgattgcataagccaagaacagatgcaacatcaagcaaacagaaaaatggttcagaacctaaaacgtgaatacgtactgggaaagatttgaagttgaaggtagagatttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattttagacacaaaaaaaccgcttgtctgacgggtgcggatttccgctnnnnnnnnnnnnnnnnnnnnnnnnnnnnnnnnnnnnnnnnnnnnnnnnnnnnnnnnnnnnnnnnnnnnnnnnnnnnnnagatttgaagttgaaggtagagatttgagttgtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcgagaccctgtgaaaaatatcctacgcctaacagaggagctkrycaagcgtaggggattgattawgccgataaaatcttatcggcggcaatttgagccaagaaaccgctacggcttttgtactctttatgcgttgccacaaattcatcaatacgcttgatgagataagcaggcattgtgatgttgattttttcggctttgcctaagaggtgagtaatatcaacatcaacgaaaccgaagaacatatcgtactcggtaaagtcgggattattgcggtgattattgattgaggttggtaatggaacttcttcgcccatttcaaccaataattccaaatgccctttgatggcttctttggcgttagcataggcttcttccaaagtatcaccggcagaatggcaacccggaatatcagggacgataacgccgaatgcgtgagtttcatcgcccggttcgattgcgattggatataacattttatgctcctgtatagcagggctatttcagccccgcttgtttaagtattgaatgttccgttcctttttttaaatccttttcaggatgttggacggtaacaatcccttttttggttggatgagtgaagtggtggtggcttcctgttgtgtgatggaatttccagccgtccgcttcaatccgtttaataatttgtttgctactactcacattgctttgctcctctgtattgctaatcaatgtggttattatacctataatttagggtgacgcaataaaaatgtagattatacccacaaattttaatttaagtgatttaaaaatgaacaaataaagtaaaggaggttgaaatggtttgttatacggtgtggataatgatattggctttgataggttgaaaatgattaaaaaagtgcggtcaaaaaaatgcaaggtttgcggaaatgcgtttaaaactaatgatagttttcgacgatggtgtagtcctgaatgcggggtgaaattagctcaaatggcattggtgaaatctcaagaaaaggagaagataaaaagggaaaaggaagaaagagcaaagattaaggcggttaaagagcggttgaaaagtcgatctgagcgtttaaaagagttgcaaggtgtatttaatcgttttattcgcttgcgagataagaatttaccttgtatttcttgtggtcgctatcatcagggacagtggcacgctggacattatcgtagtgtgggtgcttgccctgaattgcggtttaatgaggacaatgtgcataaacaatgcagtgtatgtaataaccacaaaagcggtaatgtgattgagtaccggattaatttggtggctaaaatcggggtggaaagagtggaatttttggagagaaaagaccatttaccgttaaagctcgcagatgatgagattaagacgttaattcaggtttataaggcgaaggtaagggagttgcaagatgcacaatartctamaygattttaagaaaaaatgcagacaatggggatattgggcyacrcctagaattggtacrgaatatccgagyatawcrccrtcaatycckrttccrcaggataartattgyggtaaagtcgayccaattaatgaagatcttgcaatggagtttgaacgytgtgtgttaattatgcaaaaggtaactcgagaactttacgatgttttcatggtgacttatgtttatcgcttgccgttgaggaatgaatatgacagrcggagaattttggtgagaaaagggatatgtgaaaccttggatataagcraaacmacktataraaaatatctttayacsgctgaaaymtcattaaagcttatgttaagtcaaaataggtgtatttttgttgcataaacctccctcaaggcggtttattcttaccacaaactcacaaactcacttacaagcagcttctcaacaattcgcaaacctatcaaaattagaccgcactttaaaaggctgaaaaaacaaaggggagcctgacgctccccactacacgattaaaccgacttgttatcgcccttgtttaatcgaccaactgtttttcaaattggttttacaagcccctttcgggtacggattggattttactttaattttaatgctaatgcagtacagtttttaatcacttggaaatcagtaccgctaacaagtggcgaaatataatcacgcttaccgattttataacgatctaatcgggaaatcgagacggtataaatcatatcgcatttcgcccagcactgaatgtttgctttatcaggcaatggattgacaggcaaagcatagtgatatttttctaagggttgaggttctgttgtactgagcggaataaccgtgactaattctttattccgtttatgttttgcaatgacgacaacaggacgaactttcgtcatttccggtgattgaaactttgagaaatcacacattagcaccgatttttcttttggttggtattttaggctcattgtacttttattgatatttttcatcgatcctacattaccgtaaaaagaagatcaacaggaagcaagccacgctttgaaaccgtggtaaaaatcttggaagcctttaaccttaaattagtgccgacaataaaggcattgtaagttgataatgattaatttgcaaaaaaccttgcaaargwcgccstaaaagtgtagtatttcagctatggtgcggttaagtacacttatagcataaataaacattttttacagccctgagcagamatgctyggggcttttttatgggatttttttggtgatttattatgaaagatatggggacgcaaagttatttgtggtcgggtctcagtgggtttatcgcttggctgggcgaccagcaaaatttgatgatgataagcctttctatcgggattgttaccgcttgtgtaaatctatatcaacggtacaaggaaagtaaacttcgtaagcgtgaaaacgaacgtgcggaagaattacatcgacttaaaatggcaagattacaaaaaggattagatgatgagtaagttggttaaagttggtggcatttgttcggtgtctgccattattgccttgatgatgttgaattttgctgacaattttcgcacaagccaacaagggcttgagttaataggacaggtagaaggctgtcgccgtaacccttatcattgcccttctgatgtgcttactgtaggaattgggagtactgtggcaagtagcggggcaattgaaccgcataagcgttattcagatgcagaaattgcaaagcgttgggtaaacgatattcaagcggcagaacgttgtgtaaatcagttcgctaacggtcggctaatgcctcaatctgtttttgattcagtggtttcaattacgtttaatgttgggtgcggtaagttatctcgctcgaccatgtttcgtcaagcaaatgaaaaagattggagaggtgtttgtaatgaatttccaaaatgggtttatgcaggcggtaagcgattacgaggacttgaaatacgtagagagaaagagaaagcgttatgtttgtctggggtaaagcaactttaattgtgttattgggtattttgggcttgggtgttgcaatgtgggttcaggtacagcggattgatagcttaaaagccgacaacgcttctcaagcccaacttattattcgactgactgaacagctgaagatggagcaacaggcagtgcaaatacagcaagagatagccaataaatttaaagtaaagatggagcaaagcaatgaacagcttaaaaacaccttgcaacaagagacctgtgcaaaagtggcattgcctcgtgatgttatcagtattattaaccagttgcacaactccaccgcaaattgaatatctttctccrccmcwwgcctayactattccttgtgaacgttctgcttttcaggggaaaacttatggtgatgcwattragcatttaatyaargtmatrgctgaamgrratttatgtgcaagtcagattgataarattcgrgaatggcrgattgagaatgcacagcattgagattttaatgttaatggtttaattatggcgaaaaaaaactggaaagcgttgcaaattgaatatctaaaagcaaatgccaaaacaggtattactgttaaagattggtgcgagaagaaaggattaaagtttgccagtgcgaaacgttatataaaaaagcctgaaaccatgtttaatcagtctgaaagccgccaaacagtacgtaaagaaaaacaagcagaagcaataattcatcaagaaaactgcgaattaaattgcgaaacggacgaaaaaactgcgaaacgaaaacaacgctcttatgtgaattcgcagaccgctcgaaagcatggtggttatgctcgctatttcaaagacaaatctgcctttgatgttgtagtggattttagccttaaagatgaaattgatttaatgcgacagcgtgcggtcagtgcggttgaaagtatagaaaaattcaccgcacttttagccaatgccaacaccgcagaggaaaaatcactttatgcgaagctgattgagtccactgacaaagcacttgaaagagcggtcggtcgcattgagaatttaaatcacacggacaataacattgcaaatctcttaagccaaattgaattacgtaaggttcagtctaagaaagtaatggcggaaacagaaaaacttaagcaagagatgaatgcgaaaacagcgggacatcataagctcgaataccttcaggagtttaactaatgcgtattgtttatcgtgcttcagaaacgtttaaaaaagtacatgcctcaactgcgttggttaaagccattcgtggacctatcggtagcggtaagtccgtggggtgtgtgttggaaatgtttcgtgttgcacaacagcaagagccgaatgcacaaggcgtgcgaaaaactcgctgggcttgtgtgcgaaacacctatcctgaattaaagggaacggtgattaaaacctttcaaacgtggatacccgagcaaatttgcccgattaaatacgatagtccgattacaggtaagatgaatattaatcatcctgatgggaaaacacgtattgaagcggagtttttgtttctttcgatggataagccaaaagatgtgaagaaactaatgtcattggaattaactggtatttggatcaatgaagcacaatttttacccgtttcactggtaacagaagcggttacacgtaccggtcgttatcctgaaaagcgggttgaagaagggtttatgggggcgacgtggaacggtatgattatggatactaactcgcccgatgatgaccattggtggtatcagtttgaacaagggattgatgaggaaactgaacagcctttaaagcctaaaggttgggagttttttgttcaacccggtgcattaattgatattacaggcatgcctttagcgacattgtctgatgagataaaatgcaatattgaacaaggacattatgatgattatttaggacatcgttttgtggcaaatcccatcgcagaaaatgttattaatcacaaaaaagggcatgggtactggtttgataatattcaggggcaaacattaaactggatcaaatctcgagtgtgtaatgaatttgcaaccgttcaacaaggcaaacctgtttttggcgatcacttcaataaagaattacacgtttcaacagaaaaactggtaccagtcaaaggttgggaaacctttatcgggttggattttggtttaacacctgcggcgattatcggacaaattgcacccatcggacagttgcggattgtagatgaaattgtcgcaacaggtatggggattgagcgttttattacggagcaattgtcgccattgttaagaagccgatatgcagagtgtgctattcaaattataggcgatcctgcaggtgttcagcgagcacaaaccgatgaacgcacatgttttcagttgcttgaggaatacggttttaatgctcgtccagcagaaagtaataatacgacagcaagacttgaagcagtgcgttggtggttatcccgtttagtaggtaaaggtcagccggcaatgttgattagtccgcactgtaaaacattgattaaaggatatgaaaccggctatgcctatcgtcaattgaatgtgagcggtgaggaaaaatatactgaaacaccggataaaaatcggtattcacatccgcatgatgccaatcaatatctttgtttaggtgcaatgcctagcctttttaaagagcaggttatcaatattaaaacacatcaaccactaagcaatattacaggatattaacatgtcagaacaacttgcaaacgccattgaaagctatggacgaacacttcaaggcattttacaggagcaaattaaacaacgtcagcccatcgtgcaacgttggacgaaagatatgtatcaataccgcaatcaatatgaaagtagtgttgacacagggaaatctaaagtctttgtgggatatacgagagcaaaaaccgatgcgtggtcggctcagatgacagatatgttatttccaagtgatgacaaaaactatggtatttcgccaacgccagtaccgcaaattgctcatcttgctaaacagcccgacagccaagatccaatgcaaatgcaacaaatcaacatggcaaaagagctaatgcaacaagccaaagagcggtcggaagctatggaaaaattgattgatgaccaattggcagaatgtgactatgcctctgaggctcgccttgccttgcattacgccgctgtacttggaacgggtattttgcgaggtccggtagtagatacaattgatgagcgtatttggtctgatgatggaatgggtaattggtccgcacaaaccaagtctaaaatagtgcctaaagtgcggttagtgttaccttgggattttgtgccggatatgaccgcacctacattaaaagactgccaatttgtctttgaacgttcttacctcactaaaaaacaattgcaaaatctgctgaataacccttattacttagccgatacggtgcaagccttaatcgaaagcgaggcaagcgaaacgcatacctccagcagtgatatggacggttatttagacacccttcgaaccttatccggtttagaaaaagcaagtaatgataaacggtatgaggtatggacttatcatggtggcattcctgtttctgtcttagagcaagctaatcaatctttagaagaaggctatgcgttggaattaacggaagagcaaaaatccgaaaaagcggaaattgacggcgtgattgtaatgaccggtaatggcaagattttaagtgtgaatcttaatccgcttgataccgcagagtttccttattcggtgtatacatgtgaacctgatgtcgcttgtgtatttggtttcggtattccttatttgtgtcgtgatgcacaggaaattcttaatactgcttggcgaggaatgatagacaatggtgtgttaacgattggatcgcaaattgtcgtcaatagttccgtactttcacctgtcgacaaaagctgggaaattaaaccgaataaattatggcgaaccaatgatagagtttctgctaatgcaagttttgaagctcaacgagcttttggcgtgtttaattttgaaagcagacaacaagaattggcgaatattatccaactggcgaaatcctttatggacgaggaaagcggtttgccaatgattgcacaaggtgaacaaggtcaagttacgcctacattgggtggcatgtcaatgctaatgaatgctgctaatgcggtacgcagaagacaagtgaaagaatgggacgaccaagtgaccaaaccgcttatccgccgtttctatgaatataatatggcgatgaatgacgacccgaacatcaaaggcgatatgcaagtagtggcaagagggacgtccgccttgttggtcaaagaaacacaaacggcacagattattgatattttccaaaaattcggcaatcaccctcaattgtcttatgcgttcgattggtatgacggggcaaagaccttaatgcaatccatgagtatgggggcgaaaacgatgctgttatcaagggaagattatgagcagaagctccagcagatagaacaagcgaatgcgacgcaaccgcaagatccggaaattctcaaatctcaaatgcaaatgcagttagcacaacaaaagcaacagcatgaaatgcagcttgaacagatgaaattgcaacatgccatgcaaattgagcaaatgaaagtagccatcaaagagaaagagcttgaagtaaaaatgatggaaattgaaatgcgacaacatcaagagcaagaaagaatatcacttgatgaacgtatcaacagtgtcaaagtctcttccgatatgcaacgagaaaccagcaagcaaatgttagatatgaagaaattccaagcggaaattgctttaaaacaacaacctctcgccaatccgacaggaaactatggtgtagagtaattattgacattgtagaagttcagtaattccaaaaaaaacaaaccccaagtaacggctaattacttggggtttttcattccaaataaccggaatataaggaacgaagatttatggaaagtttaaaacttatcctatcaataatcaaggagtttagaaaaatgacggcacaattatctaatttacgcttttgggggatatggctgatcggtttcttaatcgcattatccatttttataaatgcggtaaaatggtggtaacnnnnnnnccaaaaacaaaccccaagagccgcaaactcttggggtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcttgcccctaattttctgaaagccgttgcagattttatcttgacgatgaaaaacagttagagtagtatttacccatagagcttcaaaactcttttgtaacaatctaaaaaattcaatctatggacagggtggtgcggaaatatccaatacccacgccgtcgttacagcggttttgaacaccctgtccgcccacattctattcaaaaggaaatgtaacaatgtcaaattctactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaaattactactcaaactctttctttccatggttcagatcttattactctcaaagttgaaaatgttatctannnnnnnnnnnnnnnnnnnnnnnnnnnnnnnnnnnnnnnnnnnnnnnnnnnnnnnnnnnnnnnnnnnaaaaataaagagaaatatgggtgtttcgatatcgaaacacctacaaatggcggtatgcaatcaatgctctgtatgccaatcaaaaaactcaacggctggctgtttagcattaaccccgaaaaagtgcggtcagatttaaaagaaaaagtgatctgctaccaagaagaatgttttgaagcactctacaactactggcactttggcaaagccgaacgcaaaacgactgttaatgaacgcaccggcttacgcaatgctgtaaatatgcttgttagcaaaaaaggcttactctacaacgaagcctacaatcttgttcatcactatatgaatgtggaaagtattgaagatatccccgcagataaattacaaagtgcggtggagtatgttcataaaatctgcttggagggggaactgattattgactcaccgaaacaagatgatgaccttgcagataatctaacgttaacctcaatgtggttcgcactttacaattgtttagatttgttagggcaacttgaacaacctttgcgagcaattggctcgcacttcggttcaacggcatacactcacgctacggaatatcgccatacattacaatttgcgagagatgtgctaatgcaaaaattagagggcgtagagattagctcttgggaagagccacactaccatttagcattgaaaacaatgcgagcaagagaatacccactgagaagaggtattaatagacgataatttagcaaaaattcacaaaccagaccgccaaaagtgcggtctttttttatttatttttaaggaaataccatgtcagactttagcctttccaatgaagaatttcagtatttgcaaaaaaacatattaggtatcgcaccaaatgcaacaggttcaagagaacgaggacaatcggatgtcgcagatgagggttcttcgtccattgatgtcatagctaaccaatacaaattgccggaagagcaaggtttttttgcggatgtggttgatagcgttcaaatgggggcatggcgtggagcaggtgatttagcccgaggtataggagctttatttaacagtgaatggttaaacaaagcggctgattatgcctattacaacgcagaagaaaacaaagcgaccatgtcaagcaaaatgcaagaagccttgggacagagtgcatttgatggctggaatgaagaaactggagaaggcaaaggtttactcaatatgtattggtgggcgggcaatttgggagcattgctcggtgaaaacattgatacagttctcaccatgggagcgggtaaacttgcgacaacaggaataaaagcaggcggtaaacttgccggaaaatatttcagcaaagaagtcgcagaccaagtagggaaagcagcggtaaaacaagcaagccgtttcggtattcccgctcaatatcataaaaccattgcctacacggcgatcgcctctgctatgtcggcgggtaatcgtgcaaatcaagttcgagaggaattatcgcaaattagcgataatgacctagctcaacataatgactttcgtattgcgtattgggatttaaaagagagtgatgaagggcaaacactttccgaccatgaaatttttgaacaagcaagacagcagtattacaacaaggtcggacgagatgcgatactcaatcctcttgcgattgccgcagatattactgctaatgctgttggtggtttagggggtggtctttggggtctaccaaaggtaaataaatggctgggcaaaccgacacaaaatatcaaagagggtgtattaaaaggagcgttcattgaatctgcaacggaaggcttacaaggtgcggctgaacaatatgccatcaatgacacagcaagagattattacgatagtgaccgcagtttaactgagggcatgagtgaaaatattgctgatggcatggtattaggtgcagggttcgggggtatgacaggtggctatgaagctatgtctcatcgcagaaccatgaaccgtgagaaaaaacgccttttagaagcggtgaatacgggtgatgaacgagtggatgcacaaattcgttatcaagtagaagcctataacaaaattgccaatgatttagatgaactgatttcgccacaaagaatacaaacattaaatcaatttggcttacaagcggttgaaaaagctaaacgcagagagcaaattgaagcggaattaagaggggaaacacaagctcaagcagaaaaacaacaagcagagcaagttcaaacagtaaccgatacaccttaccatcaacgcaatttagccgatattcaggcggaatttatccagcatggtttagatgaaaatgattttaatgattttctagaagccaacttgcaacaagcgacagcagatttacaaaaacttcaagcaaacccatttaaaatggggacagatttgcaaaaaagtttagcagaaaagaaagcctataatgcaaaactggcggacacacaagcaagagtagactactggacacaggcaaaaaccgccccaaagtttggtactgaggctactcaagcagaaagtgcggttcaagcagagagtgaagttcaaacgcaagaacaagttacccctgatgaattgaaattaagccgttcagccccacaagaaacgcaatcattctatgaaaccgaacaaggattargtgggaaagagggtgaatttagtgcaaacaatgatgatattcggtttagcttgaatgagcgtgcagatagtgattttgctaaagcggttgatgtcgtttctcggggttatcctttatctcaacatgtcaaagtcgggacaactcctgaagttttgaaaatgttgggattgcctgatgttagagtgactattagcggtgaagtgttgcacaaagtaatgcaaggaaaacacaatgttacggctacaaccttaaaacaattgccaagtcaaatcaataatcctgttgcagtaatgaagtctgaaacacagcctaacggctatgtggtactgaccgaattgatagagcaagtgaacgataaaaataaacctgtgattgcggcgttgcatttaaaacaaaccaaacaaggtttagagttaattaatattgccagtgtttatggtagaagtaactcacaaatccagcgagcattagagagtaatttgctttattggaataaagcaaaaggttcgcaatttgtgactgccttcgggcttcaattgccttctcatatgcagtccgctacgaacctttctgtcgctaatattaaaaccgaaactgacttaagtcaataccaacgctcaacttctcgttcggcgatgaaaatagaaaaaggcaacttgttagaaatgacctctcgcgtatcaactgcggagatttctagctcatcgcctttatctagtatcaatgataaacgccttttgcagattttgcaacaacagactaaatctttcgactttagccaagaaaaatcccaaattgcagaagctgtaggaaaaggactatcaaccgcattttgaggtggtgcattcttctgaactaggtattaacgacccgactattgaagcagcttacaatacccaaacaggtaagattgttattattgccgacaatattcgagccaatgacattttaacacgtgaagagcgtttaaaatgggtagcgtggcatgagctggcacaccgagggctacaagtgcggttcggtaaagagttccaagccttratggaacaagcagaccgaaatacgacagtgcgagatttagcaaccgcacttcaaaaagaccgtgtagaacttcgaaataatcgtaccttggcgatagaagaagcgatagcrgaactgcacgcygcttataccacaggcaaaatggaagagytraaaagccgttatggtctagttgttcctcgtggtagagaaataagcctaaaatcttggtttaraatyacygctgaacgcattcgagagtttatggtaaaacttttcggacgtgaaaaagcaaatcgttttagtcatgatgacttgcttaatttgttgaaagacattcagcaaagtgcrggcggcgatatamaygaagcggataataatacacgytattccttaaatgaagatccaaattcaagttttgctaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcttgtctcgttcaagcacttatcaatcaggcgataatatttccgtattagaactttctcgtggtggaaatattcaagcaccaaaatggacggataagttcagcacgcttcaagccttgaaagaaacttttcatcaaggaacggcaaaattggacgaatggtttgctgatagcttaagaccggtaaatgattggatagacaacatgcagtttagcgatcataccagcaataaaagtggtcgagaccatgaaaaacgccgtttaaaagacgcaatgtatacagcaaaaggaagacgtgatgccttaaattctgagtttgaggttcattatttgaatccgattttgtcgaaaattgcagaaattgctaaacggtcgcagggtaaaatcaacgaagaaacggcaaaaagaaaagccggyttttgggtttcagcacgttattccattgaaaagaatatggagctattgagcattgatgaaaaagctatgcaagaggctcaaaaagccttagatgacgcaaaaatcaatgggacagtagaagatattcgcaaggcaaaaaatgcctttaattcagcacaaaaacactatcttgaccgtaaagcggcagtatggaataaagactttaacaacaagcactttaaagcaggagttgccggcggttggtctattcctgaagccaaagaaattatgcgtaatattgagcgtgatatttcgcttagggatttaacggcaattggtgatttaattgcggagttaaaccaagcacggttagaaattgattataagagcggtcgcttaacagacactgaatatcagcaatttaaagcgaaccgtcattatgtgccgttgacaggcgatccgaatgcacaattagacgacatggattttatcgcaggtgctggggcaaattcgttgaatattgccaaggataaaaccttaaaagggcggacaaattctgaggcggaagatgctattgacgcaatttggaaagcggtagggaaatcgacgacttatgcagggtggcctgaatttaaagggaaacttgatgcgttgcttgaaacggaagtgagtttgcttgaacagcaaggctatagcaatgtggaagcacaacgcctagccggtcaaaatttagggattggcaaacagaaaatgcaaggactgacacgcagtagcgataatgtgttaattgcgagacgtggcggtgtgtattatgagtacagtttgccgaataacgtcattgctgccctgaaaaatgataatgtggagcaggcaaatgatttcctgaaagtgttatctaagcctacccgttggtatgcaagaggagtaacgcagtggtcattggcatttgctccgattaatatgctgagggatacatgggaaaaatccgaatttattcgtgtgcaaaaagtatacgacagacaaggtaaattgctcagtagcgataaaatggatcaaatcggaagagcgactgcactttcacccctaacaaatcctgctatttgggcagcaacgaaacgctttgcttttgggcaagaattgcgtgatagtgtgttagaagaaaagctattgaaacagctactcaaagagggggcgatttcaacatatggtacttatctcgaacgcacagaagcggatttactcaaacgcattaagcgagaaaatagcgtgctggggagtaaaatagacaaggcaatgggcgtgattgaaagttataatcaaactttcgatatggtttccgcactttctgcttacaaggcgttagtggataatggcgttgatagtaaacaagcagccgcaacaacattagaactgactaactttcgtaagacaggttcgaaaatgcgaggtattaaagccttgtatatgttctctcaacctacagtcatgggagcggcgaacttaattcgttatctttcaacgaagaaagggcaaatacgttttctgacgtataccgcaggaatgatggcactttatagcctcttgcgttctatggatgatgaggacgaggcagggaataaaatggatcagctgggtgatattacacgttttatccctattccaataggcaatggaaattatattaaacttcctgtggggtttggtatgcctcaaatggcgtggaattttgctacaaacattgtgaaaggtgcggtgtctgatatttcctttatggaggcaggcgtgaatatggttacccatgccacgaaaacctttgcacctgtttcgccatcggagatttccgctgtgaaatacccgttggaaaaattggcactaacctttacgccaagtattttacaaccgcttatgcaaaatgcgttaaatcgttctgcttttggtagtcaaatcacgacaaattttgttcgccaagacaaactcaaggctgaacaatccaagtcgacgaccgcacaattttggaaggatttagcgattgatattcaacaaaccttaggtcttgatatgcaccctgaacaaattaagaatttgtttgatggatatagtggtatgttaggttcattgaaggagctgaatacgtggcttgtggaaaatccgaaccgtgagcaattggggcgtaacacgagaacattgttcattaatcagttgtatggtgcaggtaatgaatttgcggtgcaatctcgttattatgaagcgagcgaagaagtacaacaagttgctaaggagtatgcttatcgaaaactcaataaacaattggatagggaatggctaacgcctgaacgccaagagttaatcaaatggcatgagtataacttgcgaaccatgggcaaattacgcagtgaaaaggcacaactcaccaaacagttaagagcgggaaaaattagtgcacatgcttatgagcaacgcctcaaacgctacaatgaagcggtaaactcggtacagaaaaaactgctgtcaggttatcgccaaatggtagggttaagcagttattgacctgtaaaaaaagcaaataaagcctgtgttaaacaggctttttcggcgtgtaataatgacttgctcatttctttttaatagattaaaatctataaaaaagataaataggcaatgtaatgcaacaagagtggaatgtgattttgcaagatcctgttttggagtggtttaaaacgctaaaacaagaggatttataaaacgatgatagcccttgctgaacaaacttatgaacactacctttcacaattagagcaggagtagcaaaatgagcaaaaactttaaagcattgatggcagaattaccgccggaacaacagaacaaggtgaaagaaatggctcaagaaatgagaatggagctacaactttatcgtattcgtgaagtgctggaaatctcacaacaacaaatcgcacaagcaatgaatatcaaacaaccctcagttgttgctttggagaaacgaggaaatgatgtgcggctttcatcggtgaaacgttatgtggaagccatgggtggagtgttgaatttatctgttcaacttccaacaggaaagacaatctcttttaacttgtagcattcataaagcgacataagatatagttgcctgatattttgcagaaattgccgagttatattttcaatgtaactcggttttttattggggaaaaacatgattcatttgtcctgtgagcttgaaaaagagcaattaaacactttttttactcagcgagtaaaagaatatcaacaagatttaagtaacgagggattaaatgcccagcaatataatattttgcgagggcaaattaaagagttgcaggaattaatcgctttactaaatattcattcaaactgaacctacccaccaagtgcggtaggttttttatttttaaccattcaataagccgctttatgccgctttaggagaaaacaatggaaaatcaagaacaccaagagttcaacgaagatgccgcttttgatgaagccgcgaaatcgctcgaaacaggtgaactgactgctgacagtttgccatctgatgccgagaaaaccgaaaaggacaagcctgatcagcttgaatccgaacctgaacaacaagaaaaggttgaacaggacgatttacccgattggttgcaatctgccacagatgaagtgaaagagaatttccgcaaattgcaagcagataaccaacgttaccaacatcaagcccgttcacaaaatgggcgtgttggagcattgacgaagaaatatcagcaagccgccgctgaattggaacgcttaaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcctgatgcggagcaaattttagccaatccgcattttgcaacatggttagatcgtcaaccggcaggtattcaagccttgtttacgtctgatgatgtgaatgacgctatttatctgctttcagagtacaaaaaaacggtttccgcacatgaagcccgtaaagcaaaacaaaatcagcaactctccgccctttctttaccaagtgggcgaaccgttcctaaaggtggggaagaggtggacgaggatgtttatttcaatcagatcgccgcacaacttgacaagcagcggtctcgttattagttcatcttaaaagaggaaaaattttatgactacaatgacaaaatattctgacattagcccacgtactacagtgtatgcggcagctcaaatgcttaatcatgcagagccgattttggtgttaaacaaattggggcaaactaagcctattccaaaaaacaaaagtcaaaccatcaaattccgtcgtcctaagccatttgctaccgcacttactgcattaacggaaggtgtacgccctactcagcaaaaaatggcgtatgaagatgtcgaggtgtccttgaaacaatatggtgcatggacggaaattaccgatgtgattgaagatacacacgaagatccggtgttaaaagacattactatgctttccggtgaacaagcggcggaaactgccgaaatgttgacatggggtattttgaaagcgggaacgaatgtcatttattcaaccggtacagcgacgagtgcggtaaaagatgtattaagcattaatcacattcgtgctgcggtgcgtaaattacagaaaaaccgtgcgaagaaaaaaacctccattttagatgcgtctattaaatatggtacgaaaccgattgaggcatcttatattgcggtttgtcatactgacttggaggcggatattcgtgcacttgccggttttacaccggtggctgaatatggttctcgttcaccgattgttccgcaagagtttggtacggtagaaaatattcgtttcattacctcgccattgtttaccccacaagaagatgcgggagcacagtcaagcgatgtagtatcgaaaagcggttcaaaagctgacgtgtataacattgttatctttggtcaagacgcctttgctacctgtccgttaaaaggcaaggaatcggcagatatgctgattcgcaatccgggtaaacctgaaaaaggcgatgagttagggcaaaccggctcggtgggttggaaaatgtggtgggcaggaaaagtcctcaatgaggcttggctcgtccgtattgaatgtgccgctaaaaaactttaacccaattatcacaagtagccccatgtaaaagtggggctttattcttcatgaggaaattattatgtcttatccatttatttcatttaattcgacagtagaacaattaaaaacacatttacgtgaacactgcggtatcgaaaaaagcggtagcaaaaaagaactaattgaagcaattttagcgtttgaagaggaaaacggattcgtgcgtccaaataaagacgtggcagagcataccgctcctgtgaataaccttgaattacctttagaaaagcaacgaaaagtgcggattaaaattgcagaaaccgagcaagatcgcagtgatgtttatgtctctattaacgattgggacgcattgattaaaagagggatagaggttgctgtacctgaggcggtgtatgttttattatcaaaagctggcgatcaaacctttacgcaagaaaaagacggctcactgacggaaggtttcagtcctcgctatcatgtgactttattaggttatgaatcatgaattttttagcgttggctcaacgtttacgccaagaaatgaatgattcaggtgaaggacctgcacaagtaacgggacaacgagggcgaaatttagagtatgtgaatgcgataaaagaagcatggcttgatatacaacaatgtcgcccttgggcggttcagttttggcaacaaggctttagccctgataaattacagatacttgaaaacactgttgatacgccgttcattcctgcacaatatcatcttgcaatcgtattttatgcgatgcaatccaaagccatttcacaaaatgcacaagaattgatattgcgaggacagcaagaatgggacaaatatctccatttactttgtcgggactttttgccgacgttgaaagtaggtaggtagacaagctatgttgattattttagaatagccatattattccattttatttgaggtctttatgtcaaatcctaatgctccctacattcgggaaattgttgatcgctcacgcctaattggtggaacagcgatccaatctcaacggaaagatgacgtaaaaaaagccgttttacaggtattttctcaacaggctyaacgcttaaactaatttgtcaaaaaaccccgacttgttcggggttttttcttgcctattttcaggagttccaatgaaactaccgcaaattcaatcacagtttgttgcgataagtgggggtatggatttaaccacaccgcccattgttaaagcaaatagtgaagctattattgcgttaaatgtacaacctaattacggtggcggattttctcgtattgaggggtatgaatgtttagacggtatgactaccccctctttaatgaaccattttcatgtgaacgttaatcacgatgttccacaaagtgcggtcggaaaacagtttttgttaaatgaccgcacttgttatgtgttagcagtgaatgaacgttgtttaacctttgccgtttcgggacagtttgaggttgatgtcggtacaacctttgaccttgataggcaaacctatcaaaccatctcaaagacttttttgaatgcaggagaggccaaacaatggcaacattaccaagcactggcgtttcaagcgggagtggacaatgtgcaagcggtaccgggtgaaaatgccttgcgtggtgttgttgaacttaacgagcaaattatcgcatttcgagatggggaaaatgcttgtgaggtttttttagcgaccaaaacaggttggcaatctgcacctaccacttattttgttgagcttaaagacatcagcaagccaaaagaatttattgacggtgtgaagtttacttccggggaaaaacaaggaaacgtattttctgccgtgttgtcggctgatgatagtagcggttatcttgtggtcaatactgctcttttacctgcagcagaaattcacattaacggcaatgttgcggctaaggtgaaaagctgtgaagcggtcagattgacaaaggaaaaggcgtggacatttatttatcataatttttatggtggtacggaaacggcttatgcttacggttgtaacggtgagcaggtaattgaagttcgtcctgatggtattatcgtaccgattataacccaagcggaaaatcctcaatatattgttgcacatcgtaaccatttatttatcgccttttcagggggacaattcgggcattctttagtgggcaaacctactcattgggcagtattgctcgggtcggaacattttggtgtaggcgatgaaatcacagcactgtcttctaccacagggggcgtactgttaatcggttgtcgccataaaaccaccgcactttatggctcaacacgtgatgactgggtattaaaagatattgccaaggtggggattaaatcaggtacgctacaagcaacctttattccgattgccattagtcaacatggtattattcgtgtcgatgcaacggagcaatttggcgattttaaattaagcgaaacagactccggtcgcaaattgggtttcaaacccattgaaaataatattgtcttttcttccacaaaagccaaagcaaaccaagtgcggttttattcggagaatgcgtttcatatttgcatgatgttacaaccggacggcagtacaaaaagcacctatttcacttatcccgaaaaactaaaaggcgtatggcaatctcatcacaatacgtttttagcttttgatgacggcaaagtctatcgtcaatcggatgactgtttttcttttgcaggcaagccgattgaatggacagtgaaaatggcatttaatcactgcggttcgcctgtgcatattaagagctggaaaagtgcggagttacaagctaccgcacagggtgttttgtctgtgcaatatcgtttcgatttggattataacgctgattttcatgcagtaaatcttgcacgggagttatttgttatcggtcatggtggacgttggaacgaaagttattggaacgattttttatggtcttctcaggaatacgccacacccgtactttatttatcgggttacagtcgaaacctatctttatcttttgccggttcggatttatacgctcctcaatttgaactgagcggcttagtgttaaactatattttaaggagatttcatcgtgtctaaaaaattaagaaattggtacaaaagaactcatgattttgcaccctatactcgtgctgacggaaaagcggtatcagatgaatttgatgcaatccaagcgagttttgaaaaaatgcccgctatgcgagatgacggactgggctttgaagaaagtccggttattcccgacccgacacaggataaccaccctgtacccttacatttgttaaaaacggcggaacaatcggtttatgcggcgagggataaagtcacggagcttgctcaacaagttgcagacaataacgcaacaacggagcaaaatacccgcttagctatccaatccaatgaacaagcccaacaagccaaaacagaggcgagccaatccgccacacaagcgattgacgccaacaaccaagctcaacaagttaaaacggcagtacaaaaagcgaaagagaccgcagtttcttcaatgcaatctgcggaacaatcaaaaaatcaagcaatacaagcggaaaatttagcgaaaaaatgggcgtccaatcctcaaaaccaaatagtacaagaggggaaatactctgcttaccattatgctctagaagcagaaaaatacgccgaaaaagtcaaagcgaccgcagaaggacgtaaagattggcaatttattgataacgtccctatcagcaaagatattaacgacagctcagagacaaatttagccagtgctttttcggttaaaaccgcctatgacaaagcggttgaagcggaaaaaatagcgaatggcaaaagcaattttaaaatagaacaaggcaaagacaacgcagacgactacaaaaccgacgggcattattattttgcgagcggtcagcatttgcccgataacggagcgtggcatrttgaagtggtgagcggtgggcaaactaccgccgtgcgacaaattgcacgcaaagcnaaygataccrgcgtcaaaactcgcttttttaatggttyarrktggacagcgtgggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaatccaattgcgtcgcatgaattcctaaagcaagggcgattttttcccttgtggcttttcgcaagtgagatgatttttcatattgactatatgcagattgagtaatatttaaacggcttgccatgtctttttgcgttaatcctaaatgctcacgccacgcaacaagtgcggagcaattattttctaaggcaaaagtcgctacagcaaaaggcacgccactatctaaaggagaggagagttttgcctgttgttttaaccattcaagggtagcaatgggcatgacggcaaaagcagggtgtccgctttcatcatgtaaatattgaatgttagtaagtgcgttcatctcgttttttcacctcttcaatggaaataatattcatcatatcgccggcaatttcaaagaaaactcggtaatcgccaaccctaaaacgataggggtaacgatgattaacaagggcttttacattagaacaaaaaggaaaatgcgttaattcttggcattttcgtgcaattttcgcccctgttggaatttttcttaattgctttaacgctttgggttggaaaataaccgacttcatgaataaagaatataagttaaatataagtttattttagcaaaaacaacaaccaaggacaacacatgaaaatctacttcaaagacggcttttatatgagccacattcacaaaaatattccccaaggtgcggtggaaatctccgaagatttataccgctctttactggtgggtcaatcagaaggcaaacaaataatcacagatgaaaacggttatccgcagttagccgacccgcaacccagtccatttcatcatattgaaaaggggcaatgggttatttcgcctgaaaatcaaaccgcacttttaacccaagtgcgggcggaaatgcgagagaaaatcaatgccttgcgagatgaaaaaatcaatggcggggtgtttgtggaagcggtgrgcaagtggattgatacggacgctacggcggagcggaatatcttatccgtcaaagccagttatgatttattcggtgatatggaaattgcatggacttgtgcggataactctgtattgatgattaacaaagaaaaattaatgctgatttggcaagcgttaatgaacgctaaaacargtaatcatgctaatgccttgaagcataaaaccgccatggagcaatcggacaatccggcggaatatgattattcggacggktggacaaaatgctatcaggattatttaaaggagcagaatgatgagtaaattaaaatattggttttatcatgttttaattgccgttgaccaattactcaatgctgtttttggcggtgcagcagatgaaaccttttcaagccgttgttatcgtggtgcggtrttgrcraarmarcckaaaaaacgttggcgagtgatacataagattgttgaaacgcttttcttttgggaaaagggggagcattgcgaaaatgcgtatctgtcggagttaaagcgtaaacaatatccagaggattttagcagtaaaggttagtcaatctattatggctaaccgtctaaaaataacaaaaccgctttgtattttaatatatgagcggttttgttttgtgtgtcataccgacttttcggcatggcttttttctataacaagaggacaaataatgggcattttaaattcgatgagtgaggggctgcaaaaccccaagcaaaaaccgcttgcacaaggcactgcgaccgcacaatctcaaaacactagccaatcaatgccatcaatggctcagaatgtaacgaacaaccttaacagtaattcgttattaatgaaaagtgcggcacaaaaaggcaatcgaatggcggcacaaagaggattgcaaaattcaaccatagggattgagtctgctcaacgtgcgatgcttgatgcggcgattccgatagctcaacaagatacgcaaaatcagcaacaaataaccgtagcaaacttgaacgctaaactttcacatgataacgcaatgaaagagttgggtgctcaagtgtcggcgaatacaatcggcaaatctattgattatgcaatgcaaattacaaataactttgacgctcaaattgctggtgtgctgaataatacgcaaatgaaagaggaggataagaaaaaagccattgagcaattgaaagcaagtcgagatacggaattgagttttatgagtaggtttatgcaaaaaattccgacgacacaaaaagattgggcggcattcccgtcattgggcgtaccgacaatcacaatgaaaccaacagaaacagggggtaaagtatgagtttttgggattcagcttggagcgtaattacagagtctgccaaatggatggaaaaaaaccaagtggcaacaaatttaatgggaagtgtactacaaggaactgcgggctattttcttcaaaaagagcaagctaaaaatcaaatgcgacaacagagagagttgctgaatttgaaagatgaaatgcaatcaaaatattctgcggtaccggaagtagactcaggttatggtggacttgtggttgatgaggcacctaatttggcgaatggcggtattttaactgaaatgaaaaaaaaggtagatagaaaagnnnnnnnnnnnnnnnnnnnnnnnnnnnnnnnnnnnnnnnnnnnnnnnnnnnnnntcgcgatagagatagagacagaaatacaggtcgcaataatagctatgatacgcaaagtatggataatttagctaaagctattcacgacggctcttatcaaggaaaaaatgatagcagatggtctcgtcgagacaaggacggctatagttcattcggtcgagatagagataatgaaaagtatagtaactatgccagcagttattctaaaggaaaaagtgcgattggaagtgcggtacaaaaccatcgaaatttagtagctaattctccgtccgatctcaaatcaaaaacgctaacgggtgaaaatgttgatgatggtttgttgtcctcaaaccaaaataagcaatatagtccaattgactatgctgaaatgtataaaaacggacctcgtcatccgatagaaaaagcaacgttgggtaagcgagaaatgggaccgatgagccgaattgcacctgaagatccacatgctaacagctatcaaaactacagatatgtacaatccttagcgaataaggattggatagaagatacgcaacgaagcatagccggaaatgcggttggcggaatatcttcctccggagtggctaatgcggttgccggtgctgtagggggcggcttaggcagggctgtagccggagcagtagcgggaatagcagcatctaatgccggagatttggctaatatggcagtaggtaaagccaacaaagaaggattaacagatgaacaaaaagcaatgtacgatcaagctttctcacagagacaggattatttcgacaagagaagacgttcatttgatagtttcggtaatggtatagcgactgttcttggcaccggtgtcgatattgcttcaaaagggctaaccatgggggcaggctctaccatcgctgatgcctacaaaaataattcggcattggagaaaaccttggaaaattttgatagccctgaaaataggcaatttttaaaagaaagacaggaggcgtacaagcgtgcaagggaagaagatgcgaaaagacgcaaagcagatgggtcaaataaaggcattctctacaatatgactaaacgtctacagcctcaagaagagccacaagagccaactttaccttactatgctattccggcattaactaatctttggaataacgtcattgtgaaataaacaacaggagaaaactcaatgggtattttagataatatggcacaacaagccaatgcacaaccgcaaatgcaacaaacggcgacactaccacaaactgaacaaacgggaaatatgatgcaaatgtatcaattcttaatgcaaaactcaatgcaagccatcgcagaaacggcagagcaacgcattcacgaaaaaggaccggtagacggaacggcagatttaattgcaaccgcaatggtttcaaatcttcaagcggcacaacaaaatggtaaaaccatccccccacaagtcatgttacaggtcgccaaagatattgccatgcagttattacaacaaatgggcgtaccggaagagcaacttgatgatgtattgattgacgttttatttaaagcgttggatcaatttggtgaaatgagccatggcatgttatcagcggaagaagagcaacaatatgtcgacatgatcaacaaaatatctgaggcggaacagcaacgccaagcacaaaaaggcgaaaatccgaccgcacttgaacaggcacaaacgggaggtatgtaatgggatttggcggtattttagcctcaattgctcatggattgggcggaggtatgattaaagtcgcggatgagggctggaaaaaagaagcagacgagcgtaaaaatcaattctatgcagatcaaaaagcattagatcgagaggctgaactaattctattagacagaaaacatcaaaatgacattaattttttgcataagaaaaatgcgatttctcaagcggttaacaatagccctaatatgaaagcgatgaatgaaatcaaagacgcttttgatgcaatggacgcaggaaacaaagaaattgcacgacttgatgaattattagcggataaatcactttccaaagagcaacgagaaaaacttacaacgcagagacaggcaatttacgatcatgtttcttcagtagccaacaacgaagaaatttggaaaggaattcataaaggcagatatggtcaagcaatacgcggcaaacatattcaaatgactacaccatacaaaaagacaccatctccagtggctgtttcgcaaaagcaagctaaccagcctataattgtaccaaaacctgacaaagctcagttatacggagaagatattatgaggagataccacaatggagaattactagactagcaaaaactctaaaaacaaaccgctctttggattgaattgaagagcggttagaatttattttgtaagctgtatctttgcaagatgtaatggtagttaatgagatgtgaaaatgtgacataaatgtgtcataaaaggtgaaaaaagatagtaaaaggcgtgttttttataggagggtgttctttgattagctttgtaagtctttgttttaaatgttgtttttgttttatttggtttttattaattgctcttctaagccgtaggtcattggttcgaatccaaatagggcgtgccatttcttaaattcctctaacaaccaaccaactacagctccaatgatctaaactaacgacagcttaaaaaacaagtattttttgctatctcaaaacaaagcattgtatttatatacagtataaattatgatctaaaagaaccgattacagaatttaactgttaccaaaaactgatccaaaaacaaaaaaagtgtaccaaacagcagaattaaaacccaagccatgtttaaaaaaatcacccaagcaaggcacatgaagctacgccgccaaaaagacggtgtagaactagggtttagcggaaataccgcctacatcgccactattcatcaatacggattaagagcaagagtagaacgacacaaagaacacaaagtacaatacgccaagcgtgaattgctcggccttacagagcaggacaaagaaatgattgaagcgtttgtgatcaacgcattgagtgaaaatattgattagatgtcatcatctaaattcttatttttgcagtggcaacaatttttatcacgattggacgtatcataaaacaacacaaagataaaaaataaagcaacactgccaaaaataaacgtcagcccaacgcttaaatcaaaataaaaataacaaataaggtaaggacacgcgacaattaacacaaaaataaggtcaataaaatcattaacagtcaatttacttttcatagaaccaccgtagtttttgtcgttattgtctttttatattaaaaaatagcaaataaccgcaataagaatgatggcacttatgccccattcaaggctaaattgataatcgacctgttctttagcatgataacgtccggatttcttttgaattgccattagcactgtatccaaaagtaacatcaaaggcgttaatgcaaacgtgaataacacgcaacctataccgacagggatagaaagcaaaaaaacggaagtaagcaaggaactgaaaaaatgaatgacagataaggtttcccaactcatccttagcgaaataccaaacaacacaataacggtaaacatagcactgatgtagtacaaatgagtaacccaaaaaaaagtaaaattttcatactttaattcatcgtgtcgcataaaaacccctgtgttttttgtgtatctttgtttattttttctacgttgtcaatcttatttcaacatattaataatttgttctcgagatcggacccattcataaatcactgacaaaaatagttttggccagcattgccggttgattatcatccatatcagcaaataatgtggcaagtttttgctgtgctgtgtcataatcaccttggcttaatgcgttgatcactggattcaatattgggttcattaattgttgatatttctccggtgtcggttttaatccgtctaacacttcatcaggatctttttgtaccgataataacgctattttccctttgcctatcttttgaaccgacaaaagtgcggtcatatttggcggtgttttacgctcgaatacagcttcgttttctgttacggtacttgcagtttattcgtataaactttgttgatgttcatcaggtctggttttaaatcggcgatgtaaccacatatattgtgttacatcttgcaatatttccttttctacaatcttattcattcgtgttgctattgccgtttcatcatggcgaatatccgaaaaatcaacaggtgctgaaatgttcagcgtatatccagagttatctttgttacgaagcggtgtaaaagggataactttgctcttaggtgatgattttattaagtagtaacttccggttgtcgttgccgcctccggtacagcaaaaaaaggtacgaaaacagcattttttcttccataatcatgatccggagcgtaccaaatcatttcaccatgacgaatagctttaatcattgcacgtaaatctttgcgatccaataaacctttatttgatcttgcacgtccacggcattgtaaccaatccattaaaggattatcatgcggtcgataaatgccaatgcctggatgagatagaccaataatccttgcacctaattctaaagtgagaaaatgaatacctacaagaataataccgtcttgttgattttcttttaaatattcaagcccttcaattttgctccatttttttattcgtttatctgaccaaaaccaagccataccggtttcaataattgccatgcctgttgctttaagattggattgcaatatatcgttgatttcctgttcagaataatgaggaaaacagagctgtaaattttggcgagcgatttttgttctgcgttgaccgattttcaaatgagaaaataaagaacctaaaccgttgccgattttaagtaagattggataggggagcaataaaataagacgaaaaaataaaaaacctaaccagaaaagccagtatttaggcttaagaaattcaatattaaattgtggaattgatgtttttgccataatgttacttagtctaatacaactttgattttgcgttgtagtttaacggaaatttgacgaaatagcatttttactgtggtaaaattagcaaaattttagtgattttatgagagaaaagaaaaatgatgcaatattcagcacagtttaatcaagctaaagtactggtgctcggtgatgtcatgcttgatcgttattggtttggggcaaccaatcgaatttcacctgaagctccggttcctgtggttagagtacaagaaaatgaggaaagagcaggcggtgcggctaatgttgctatgaatattgcctcgttaaatgtacctgttcggttattgggtttaacaggaaaagatgaagcagctagggcattaatgcagctattggaaaaacaaagtattcattgcgactttactcaacttgactcgcacccaactattactaaattacgtatcctatcacgtcatcaacaattattacgtcttgattttgaagaggatttcaacaatataacaagtgcggatttattgtgtaagcttgaaagtgcggtacgaaattatggtgcattaattttatctgattatggcaaagggacattaaatgatgtacaaaaaatgatccaaattgctcgtaaagtaaatattcctgtattgatcgatccgaaaggaactgattttgcacgttatcgcagtgcgacgttattgacgccaaatatgtctgaatttgaagcggttgtcggaaaatgtcatagtgaagaagagattgcagagaaaggcttgcagttaatcaaagagcttgatttatccgctttgctggttactcgttcagaaaaaggcatgaccttattacgtccaaacaatgcaccatttcatttacctacggaagcaaaagaagtgtttgatgttaccggtgcgggcgataccgtaattagtgtattagctaccgcacttgctgacgggcgtagttatgaggaggcttgttatttagcgaatgtggcggcagggattgttgttggcaaattgggtacatcaacagtttcaacagttgagttagaaaatgccattcatggcagaactacggcaggttttggcattatggaagaaagtcaattaaaagcggcggtggaattggcaaaagcacgaggagaaaaaatagtgatgacaaacggttgctttgatattttacatccgggacatgtgtcttatttagaaaatgcacgtaaattaggtgatcgtttaattgtcgctgttaatacagacaattctgtaaaacgtcttaaaggtgaaactcgtccgattaatgatttggcgactagaatggctgttttggcgggattatcttctgtggattggcttgttgcgtttgatgaagatacacctcaacgtttaattgcagaaatattacctgatttattagtcaaaggtggagattacaagcctgaggaaatcgttggcagcaaagaagtctggctaaatggtggcgaggtcaaggtgttaaattttgaaaatggctgttctacaacgaatgtgattaaaaaaattcaacagttaaaagagtaagggaacattatgattacggtatatggtattaaaaattgcgatactgttaaaaaagcattgaaatggttagcagataacaatattgaataccaacttcacgattttcgtgtagacggtttacaacaatattggctagaacaagcggaacaacaatttggctgggaaaatttagtcaacaaacgtagtacgacatggcgtaatttagatgaagaaatcaaacaaaatctgactaaacagaccgcacttaaaaccttacttgcacaacctactttagtaaaacgtccgattattttacaagatggcaaagcgttgattgggtttagtgtagaagattatgaacgtgtattgaaataaaagatcaacaacgttctatttaacgtatggcatattgcaatagtgcaaaatgaaactatgaattgataaaaggacagatgctacgcaaacgttcgtaaaaaaataaaatcttatgaaaaataacataattactctcactcaaagtcttattcaacgtccttcaattagccctgatgatcaaggctgtcaacaacttattgccgaacgtttacaagctgttggttttaagttggagtggttaccttttggtgataccttaaatttatgggctactcatggtgaaggaaaatgtattgcttttgcggggcatacagacgttgttccgattggtaatgaaagtcaatggacttatccgccttttgaagcccgaattgttgaaaatatgctgtatgggcgtggtgctgcggatatgaagggtgctttggcagcaatggttattgcggcggaaacttttgtgaaacacctgccaaatcatcagggaaaaatagccttgttgattacctctgatgaagaggcagcggctaccaatggaacggtaaaagtagtggaaacgctaataaaacgtaacgaaaagattgactattgtgtagtaggtgaaccttccagtgcaacgcaatttggcgacattatcaaaaacggacgacgtggttctattacaggaaatttgtatattcaaggtgtacaaggtcatgtggcttatcctcatttagcggataatcctgttcataatgccttgaaattcttagatgaattaactcattatcaatgggataaaggtaatgaatttttcccgccgaccagtttacaaatcgccaatattcatgcagggacaggtagtaataatgtaatccccggtgaactttatgtgcaatttaacttgcgttattgtactgaggtgacagatgaaattattaaaactagagtggctgagatgttggaaaagcataagttaacgtaccgtatagactggaatttatcgggcaaaccgtttttaacacctcaaggaaaattagtaaatgccacaattgaagcagtgaaaaaatttactcaaatcagaccgcacttagatacaggcggtgggacttccgatgctcgttttattgccacaatgggagcggaagttgtagagtttggacctctcaatcaaactattcataaagtgaatgagtgtgtgaatattgatgatttagccaagtgcggtgagatttattatcatattttggaaaaattgtttaatgaacaataagttatcaaaaatcctcacaggaaaaagtcgtgaacatttaatttcattaccgaatacgctttcggctaatcattttttgcagatggaagttgtcggtgcttttttgcagttacagcaagctgcaaagcaagctggctttaatttacagccagtaagtagttttcgtgattttgaacgtcagcgttcaatttggaatacaaaattttatggagaacgtaaagttcatgatgatcaaggaaagccgctagatttgaccgcacttgacgattggcaaaaagcacaagcgattttgcgttggtctgctatacctggagcaagtcgccatcattggggaacggaaatcgatatttttgatcctgatttattgccaaaaggacaatctttacaacttgagccttgggaatatgaaacaggggggtattttcaacgtttaactaattggctattagttaatgcacaacaatttggtttttattttccgttttttgagttaaaagataaaaaagtgggcaatgaactttggcatttaagctattttcccattgcagatatatatcaacaacaattttgccctgagtttttatcacaagcgtggtacgaggaaaacgttgcgggtagcgagatattattgaatcatcttgatgaaatatttagggattttttgatttaatgatttaagctatttttagccaatccaatttttcataattttagaggtatatatggaagttcagcaatttactcagcaagatattgaaattcttcatgaagaaacattgtacaaaggtttttttcaattaaaacgcattcaatttaagcataaactgtttgctggtggtgtgagtggagttgtaactcgtgaattactttataagggggcagcatcagcagttattgcgtatgatccatatttagataaggtgattttagtcgaacaagttcgcattggtgcttacgatcccaaattaaccacatcaccttggttatttgaattaattgcaggtatggtggaagagggagaaaaacctgaagaggttgcactaagagaaagtcaagaagaagcaggcgttcaagtagataatttgcaacatgttttaagcgtgtgggatagtccgggtggagtgattgagcgaatccatctgtttgccggaaaagtggatagtacaaaagcgaaaggtattcatggcttggcggaagaaaatgaagatattcaggtgcatgttattagcagagaaattgcctatcaatgggtctgcgagggaaaaattgataatggtatagcggtcatgggattgcaatggttacaactcaattataaaactttgcaacaacaatggttataaaatgtgatacagattatattttttataaaaaattagataaaaatatgatcctgttaacattttcattatttttttaatgcaattttttattaaaacagtaagttataacccgtttgttgtatataaagggtgaatattttgatcagtacatatcaataccctacttcagagaaagtagttcgtttaattcagattaccgatccccatttatttaaagaaaaaaatggagaattacttggcattaatacgtatgatagttttaatcaagtattaagcgaggttttacaaagtaaatttgattatgagcttgttttagcaacgggagatttagtacaagatagcagtgaagaaggttatcaatattttgctgaatcggttaattcgttgaataaaaaagttttttgggttccgggaaatcatgattttcaacctaaaatgtttgatgttttaagtcaatatcaagaatatatttatccgacaaaacatgtattagtgggaaaaaattggcaaattttgatgttggatagtcaagtatcaggcgtacctcatgggtatctaggacaatatcaattggattggttgtcagcaaaactgagagattatccaaaacgccatgccttagttgttctacatcatcatattgtttccactaattcggcttggttggatcaacataatttacgcaattccttagacttaatgcaagtattgttaccttttagaaaagtgcggggtattttatatgggcatattcatcaagcaatggatacaaaatggcagggatataaaattatggcaacgccttctacatgtattcaatttaaacctgacagtaatcatttttctttagacacatcacaaccgggttggcgtgaaattgagttatatgatgatggacgaattgaaacaagagtcaagcggattcaacagaccagttttctaccgaatatgttgagtgagggctattgatgaaaagcgaaaagtgcggtgaaatttttgattttttcaccgcactttgttgttcaagtcatcataaataacattcgctagaatttcatttctaatgataaagcaaaattacgtccagcagcagtaaagcgttctaacccttttccgttgttatatacgtcgcccaatgcaccattctctttgatttgtcgtaatgtatcccaagtggtgtacttacgattgaataaattaaagatgcctgcatttaaggtaaaatgggaattgaggcgatattgtgcggttaaatcaaatacgacataagaactgcttaaaaaacgataaggtttgggttgcctaaagtcggatacaacacctgtttttttatcaacatccaattgcaagctatttatattcggaatatcaatagcatctttggcttttttagcactgacatatcgcccgctgaagagaacattccatttgtcgttctccgcttggtagcctaatcccaacgtcgtgctaaaaggctggattggtaacatcgccgtgccattatttttacgtccttttgcatagcttgcttttaatatagcgtaccaagatttggataaaccaattattttcccgttagcacgggcatggaaatcaagaccggtaacataggctttatcaatatttatctgctgataatttacgccatctaaataatattcagtatatttttttcttggcttggttgcccagtcaattttttgacgagatccgactttcggttttgtttcgacatcaataaaatcccgatattttgtataaaatacagccaagcttaattggtagttgtcgccttccgtggtaagagagagttcatgattttgtgctttttcaggttttaaattgatattaggtaaatattggacatcacttgccccttttaaatcaaaatacatttcttctattttcggtgctttaaaacctgtgctgaattcatagctaagtaacgtggaatcggtgagcgaataatttaatcccaacgaaaaattgaccgcactaaattgtttcttgggtaaaacttcgactttttgactggcaagatcatattttaatgcacttgtggtgggcttatagcgatagtgatcgaagcgtattcctgcatttgctccccatttttgattaatactgattaaatcctgcacataggcataccaagcctgacgggcaacaggttgctgaatagtgaattcacgttgttttatccttgaataagcaccatactcttgatttctattttctaatttaccccaatgataacccaatcctcctgataattgatgatgagcaaacttgccggcaatttcattggcaataaaagaaacatctaattgataatgcttctgttctgttttatataaacgcttgtcagtaataatattataatcttgcggagaaacaccatattgattggaattagcctgttgtgagactttttgttgggctaattgtaggctaaatttatttagccagctttccgttggggtataattataggaaataccaagtcgctgataaggtgttatatcgcccgcttcttgacgatttgaagcataaaaacttttttctaaaatttttctgctttgctcaagattttcaaaaaaaccttgcacaaaatgttgtggagtaaaatgatatcctaattttgccaaccaagatcggctgtgataatccacattatcaggtaatacacgactacgcccacataattggggaaagatatctcgctggtctccatttggtaaaatgccacaatacgcaacgtcttttagtttgccactgtagtaatttttgttttcatgtgcatggcgataggtgtattgcaacaatccctcggcgttaccctgcttgaacccccccctatcacttggcgatattccgtattacgtgagctataggcagttttagcataaaatccaacagttttattcgagtctacaaaatcatgcacattttttgttcgcatcgacacgctaccgcctaacgcaccgctaccttgtgttaaagaattcgcccctttattaaattctacactacttaagttttcaatttccgtgctgttgcgattaccattataaaatcctttaatatagtaaaagcgaggcatataactttcgaccgcacttattccatcaacactcatcgccacacggtcgctttctacaccacgcatagtataaccattggcaccgccacgccctccttcagtgactgtaacacctgtttgccaacggaccaaatcctgttcgttccataccaaacctcgactaatttgttggctatttgtgcttgaagttttagccgatacttgttgcgtttcaacaacaatctgatctaatgtagcagaatcattaaattgagcgattgtactaaatgaaattagaggcaatgtaacagcagaaaaccgcagtaacgtttgctgacgatttttatcaaaaaacataatatccctcttgaaaataagaatcaatcttattaatgataacagagatattactatatcgctattccttcttttatttatctaattggagaaatagaaacctttaaaatagcagaaatataaaattagacctttttcttactaatggtatctatccatactgctagtaataaaatgccaccttttacaatatattgccaaaaagtcggtacatccagcatactcataccattatctaataatgcaatgataaaagccccgattactacaccaaaaatactgccgataccgccggctaaactggctccaccgataacacaagcggcaatagcatcgagttctgcattttgaccggcagagggtgctccggctcctaaacgggaacttaaaatcaagccggctattgccactaataagccgttaagagcaaaaatggttaatttaactttttccacggcaatacctgataggcgagctgcatcaatattgccaccaattgcgtaaatatgtcgaccaaatgctgtttttttcgaaatgaatgttcctataatggctaatccacagagaattaatactggaattggcatgcctcgataatcgttaagcagataaattgcaccaagaataaggattgctatcatgccatatttcactgtttctttgggcattttggcaactggtaaatttaggttttgtctggctttacgctgataacttccccaagcaataaagcaaaatattatgatgctccctaaaattatccctatggtgtcggaaagataaccttgaccgataattgtcatatcattactgataggggaaacggtagtaccattcgttaatccgatcaaaattccccgaaatgcaagcattcctgctaaggtaacgatgaaagatggtactttttgataagcaacccaccaaccgctccacgccccgattagtaaacctaagagcaaggtaacaaggatagttaagggtaacggccaaccccaccaaacattactaattgccgcaaagccaccgagtagccccattagtgaaccaactgataagtcaatttctgcagagataatcacaaacaccataccaatagcaagaataccagtgatagcagtttgacgtaataagttagagatatttcttgcacttaaataagccccttctgttgcaattgagaaaaaaaacataatcaccataatggcaatcagcataatatagacttgtaaattgattgatttgaacttattcatagcttactccttaagtgcggcttccattacttgttcttgagtgagatgatggttgattaaatccgctttaactttaccttggtgcattactaatacacgatcgcttattcctaaaacctcaggtagctctgaggaaattacaataattgacattccttcctgagctagttggttgattaatttatagatttcatattttgcaccgacatcaatacctcgagtcggttcatctaaaatcaaaatgttaggatgtaataatagacattttgctaaaattgctttttgctgattacctccacttagccggcctattgcgagttcaggcgaggaagttttcactttcagtttggcaatagattgattgataatggtttcttccagcggttcgttaatgacttttttaccaaagcagaattgagacaaagaagataaggtaatatttttacctacgctcataataggaataataccgtgttttttacgatcttccggtaccatgacaatatgatttgcgatagcttctgcgcacttgttgattttaactttttggttattgagaaaaatgttaccttggtattttcctacataagaaccaaaaatacattgagccatttcagttcgccctgaaccgactaatcctgcaacaccaagaatttctcctttccgtaatatgaaattggcattatcaacgcgtttaatatgtgtattggttgggtgccacgcagttaaattttctacgcgtaaaatttctttgccaatatcgtgtggctcgtgtggatacaatgaggtaatttcacgtcctaccatcatggtaatgatgtcatcttcgcttatcccttgtgctaattgagtgccgatgtgttcaccgtctcgaattacacagatcttatcggaaattgcttttacttcatttaatttatgagaaatatagatacatgcgatattgtgagcttgtagacctttaatcagattaagtagaatgtctgtttctttttcggttaatgaggcggtcggttcatctaaaatcaataaacgaacttgtttattcaaggctttagcaatttcaactaattgttgttgccctaatcccaatgtactcactttggtatttggatcaatatcgagctgaacctgctctaataaggttttacaacgcagatacattttgttgtcattagtaatacctgcttgggtaatttcattccctaaaaacatattttccaatactgacatatttttcactaaagtcagttcttggtgaataatcgaaattcctttttcttccgtatctttaatatttttagcggttaatttttcaccggaaaaataaatttctccctcataatcccctgagggataaataccacataatactttcattaaggttgatttacctgagccattttcaccacatagagagagtatttcgccggtttcaagggaaattgaaatattatttaatgctacaacatcaccaaattttttagtgatattcttcatctctaataatttcgtcataacttcacccctttttttagtatggcaagacataaaatcttgccacataaaatattttattatttataaacagcctctttggtatggaaaccatctttaatcaccgtgtcatcaatattctcttttgtaacgacgacaggctctaataggaatgcagggacatttttcaatccgttatttaattgagagttggattccacttttccacctttacctaacgcgactgaaatttcggctgctttatctgctaaattagtgattggtttgtatacggtcattgtttgtgaaccgtcaagaatgcgtttgattgccgctaaatcagcatcttgacctgaaatcgctactttgcctgataagccttgagcacttaatgcttgaattgcaccaccggcagttgcatcgttagaagcgactaccgcatcaatattgtttttgtttgcagttaacgcattttccataatttgtaatgctttttcagctagccaagaatcaacccattgatcgcctaccacgttgatttcgccactgtcaatgtgcggttgtaatactttcatttgacctttacgaaataattttgcgttattatcaacaggtgaaccgcccattaagaaataattccctttcggttttttctcaataatgctttgtgcttgtagttcacctactttttcattatcgaacgaaacatagaaatcaatatctgcgttattgatcagacggtcataagctaaaactttaaccccctcttttttggcttcagcgatcacgtttgacaatacttcgccattgaatggaataatcactagcacatcaatatctttatttagcatattctcaatttgagaaatttgagctgtcgcatcaccatttgcagattgaacgaatacttttgcacctaaagcttctgcttttttcacaaaaatatctcggtctttttgccatctttctaaacgtaaatcatcaattgacatgccgattttcagatcgtttgctagcactgaatggctaaaaaccattaaaattgctgtcgcgaccgctaataacttagatttaagtttcataaaatacctcacttggttgagagaatgatgtaagggtataatgtagttgccccgagtgaagtctgcggagatttggtaataagtgcaattatcagatttattaatgtaattatgttttttcgcttttgtgatctgttcgacattaaccaataatctaaatccaaaaacgaaatatcgtaattgagggttgttttcaattttaagatgatgagccttgtattcatatttatcacatctcagaggagacttggctatgtctaattattttgacaaaattgcaaaggtaaattacgaaggagcaaattccactaatcctttcgcttttaaacactacaatccaaatgaagttattttaggtaaaacagtagaggaacacttgcgtctggcagtctgctattggcacacgttctgctggacaggtaacgatatgttcggtgccggttcattggatcgtagttggcaaaaaacaggtgatttgctggttggtgcaaaacaaaaagcagaaattgcttttgaatttttccaaaaattaggtgtgccttattatagttttcacgatgtagatattgctcctgaaagcaataatttcaaagaatatttacataacttcaatactattgtggatattttagagaaaaaacaatcagaaaccggtgtgaagttgttatggggaacagcaaactgctttactaatcctcgttatatgtcaggggcttctaccaaccctaatccggaagtatttgcttgggcagcagcacaagtttttactgcaatgaatgcaactcaacgcttagggggtgaaaactatgtattatggggcggacgagaagggtatgaaacattgctgaataccgatctcaaacgtgaacgtgaacaaattggccgttttatgcaattagtggtagaacataaatataaaatcggctttcaaggtacattactaattgaaccgaaaccacaagagccaactaaacatcagtacgattatgatgttgcaacagtttatggttttttaaaacaattcggattagaaaatgaaattaaagtgaatattgaagctaaccatgcaaccttggcagggcatacattccaacatgaaattgcaacggcaacttcattaggcattttcggttctattgatgctaaccgtggcgatccgcaattaggctgggataccgaccaattcccgaacagcgtggaagaaaatacgttggcaatgtatgaaatcttaaaagcgggtggtttcaccacaggcggtttcaactttgatgcgaaaattcgtcgccaaagtaccgacccgtatgatttatttcatgcccatatcggtgcaatggatgtgttagctttgtcgctcaaacgtgctgcaaaaatgattgaagaccaaacgttgcaaaaagtggtcgataaccgctatgctggttgggatcaagagctgggtcagaaaattctaagtggcaaagcgagcttggaggatcttgctaaaatagtagaaactcaagggttagatccaaaacctgtttcagggcagcaagaatatttagaaaatttagtgaatagctatctttatcgttaattctgacaagcggtctttttttgcaaaattttgcataaaatgaccgctctttagattaaggagtatttatgtacattggaattgatcttggtacttctggggttaaagttgttttacttgatgaaaatcaaaaaattattgccattactcaaaaatctcttcctatttctcgccctcaacccttatggtctgaacaaaatccacaagattggtggaatgccactcacgaagcaatgcttgaattagctgataagcaaaatttaagccatgtaaaagctattggattaactgggcaaatgcacggtgctacattactggataaggcagataacatactttctccggcaattttatggaacgatggacggagctttgctgaatgcgaagagttggaaaaattagtgtcaaatagtcgtgaaattacaggtaatttaatgatgccgggctttactgcacctaaattatgttggcttaaaaaacatcagcccgatattgccaaaaaagttagtaaagttttgttaccaaaagattatttacgatttttaatgacgggagaatacgcttctgatatgtctgatgcctcaggcacaatgtggctggacataggtaaacggagttggaatgaagcacttttgaatgcttgtggacttgatttgaataatatgccgaaattatttgaaggtaatcaaatcacaggttatttacgcaaagaaattgcacaacaatggaaaataaatgccgtacctgttgtggcaggtggcggtgataatgcagccggtgccattggtataggactttaccaagcagagcaagcaatgttgtctcttggtacttcgggtgtgtactttgtggtaagtgatacattccgtgccaatccacaaaaagcagttcatagtttttgccacgcactgcccgatcgctggcacttaatgtcggtgatgttaagtgcagcctcggctgttgattgggctgcaaaatccctaggctttaaagatgtaccaaccttatttcaacgagttgaagcaagccaaaccgagtccaatgtcattttcctgccttatttatcaggcgaacgtacaccgcataatgatccttatgcgaaaggtgtattttggggattaagccatagcgataatcaagttacgatggcaaaagccgtcatcgaaggcgtgagttttgctatggcagagagtattgatgttttacatgaaacaggtgttactgcaaataatattgcgcttattggtggtggagcaaaaagtgcttattggcgacaattacttgctgatattagcggtaaaacatttgaatatcgtacaggtggagatgttggtccggcgttaggtgcggctaaattagcacaaattgcattaaatccagaacaagatattgcgaatttctgccgaccattaccattggaaaaaatctatcagcccaattctgctcgctatgcagaatatcaagctaaacgtgagaaattcgcagagctttatcaacgagtaaaaggtctatcgttgttttctttgtaactcaaagatatataagacttttcctgatctaaaagtgcggtgagaataccgcacttttaggggtatattttagatacaaaaaaacggcgataacaacactgctatcgccggtttagttttatatgatgaattagttaaacacgccgctgaygccgacacggaaacctaytcgrccwcgrctrtcrgargamatrccgccggakayrgcmyatttwccrtttgcggaagttctaccgaggtttaaagagaccgcactttcgctgctataacgagcggcaccggcggcgtaagaccattttcccrggacgaaagggacttctttgaaagccatagcggcggcgataccggcttttgcgtctttgttgacttcttcaagacgttggttggtggcatgaagctgactaccattgaccgcatcagtggattgatgagaaagcaaaccggcagcaacattttgaatacgrcgttcattgcctttgytkcccacggaaacgacrcctttmgcrtcwacgccagcgtaattgccstcgactttrcckataccgccggtagtctcgctttggtcggtatatctggaaccatcgcctagaaacacagaattatcagtggtaacatcaatattattacctatggcgactgttttggtgccgttattcgtaatattacgacctattgagaacgaattatctccagtcgtatgtacattactaccaaaacttattgagccctcacctgagacttttgattgagcaccaatggcttgagcacgtagaccactcgcatctgctttccaaccaagagcggtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttcatcacctactgctactgcaaaatttccagttcctttagaatctttacctatagaaatcgcctgtacacctgcatttgcttggaagcccattgctacggcataagattgtgcctctgctgtcttaccaaccgcagttgctccttcatgtgctgcatttgcttcaaatcctacagcgacaccggactcagctactttggcattttttccaacggcaacggatttggtaccatccttatacattccttctgccttagcaccttcaccaatataaacatgcccattactaacatcaatattactactatttgattgttgagcttgagccatagccgaatgagcagttaaaacaactactgcagttaaagataaataaaaaattttcacttaaaagaaatccttaaaaaaagagttaacatagaaaaatcataaaaaagctaaccgcactaagaggcgataatttatgacacgccttaaaaagaggtagggggacctaccaaagcgggcgaaattttaagcggggggggggtactgtcaatatatttttttacaaaatgtttacttttttaacaaaattgaaacggtaaaaaacatttgtcgaacacggaaaaatattcatttgtttttgtgttatggaatgcagtagaaagaagaaatgaacttgcgtaagtgatttaaacgctccacgcattttcatctagtacttgtccaaaatgactttcaacgaggcgtttggttatatcgctttgtggttgggtaaagattgtttttgtatcgccatattcgatcatttgtccttcgtccatcactaatacatgatcggctatgtgtttgatgatgcctaaatgttgacctacataaatataagagatgctgagtttctcttgaatgtctaacatcaaatttattaattgagttttgactgtcgcatcaagtgagccgagagcatcatcggtaataataatttccggtccaagaataagtgcacgtgcaatagcaacacgttgtttttgaccgatggacatggtattaatttttacattggcatgttcgggataaagtcccactaaacgtaatgtttcagctattttaagattacgttcattttcgtttaggttggttgtcaggcgtagaggtgcatctaaaatttgtcctacatttaaacgaggattaaaggcagaataggggtcttgaaagaccatacgaatatgttgtgaacgatattgataatctccgtactctaagggatttcctttaaatagaagttcaccagatgtgggttttataataccaacgatcattttggcaacagttgattttccagagccatttttaccgataatagccaatgttttttttcgtgccaaaacgaaactaatattttctacagctttaaattggcttgtgctgaagataccaatattatcattaaaaaattttgataaacctgaaacttccagtaagttcatttttacttcccgttcttattttgttgtgtttacgactaatggaccagtttccatttctttttctctacgttgactttcttttaaattaatagggaaatggcagaaaaattcatgttgtttaatccgttgtgcacttggttttcgaatacattctttttgtgcaaaaggacaacgtggacctaaacggcaaccgataggcattccttctaataatggaacagcaccttttagcgtactcaaacgacttttatgtactaagggctgtttaaaatcaggaatagaatgtaataatgctcttgtatagggatggtgaggattttctaaaatgttttctttagatcctgattcagcgttttgtccgcaataaagaactgaaaaactatcacaccatgcactaatactatttatatcattacttaccagcagaatacttgttccctgattttgattcatactggcaagtaaacgaaatatttgtacttttgtcattgactcaagagaatttgtaggttcatcagcgattaataatcgaggttggtttgcaattgcaagggcaatcataattttttgtccttcaccttcagttacttcatgtgggtaactttgcataatatctttatgatctttcacacctacacgatgtaataattcaatagcacgacgttttttccaaccgaaccattgccaccatcgccctttaaatgtccaagagggaatgctctgaataagttgttgtccaatttttcggctaggatctaaagatgctaaaggctcttggtaaatcatggagatttctttacctaccagtttacgtctttttttgggatttagttttagtagttctacatcgtcaaaacgaaaacgatcggctgtaataatccaagaatccttaattgcattacaaataactttagcaatcaggctttttccggaacctgattcaccgactaaaccacagatttcaccttcatttaaggttaaattaacattatcaataattttgactcgtccttttggtgtttctatttcaatacaaagattacgaatatcaagtaaagccatgttggttgtccttatccataatatttttctatggctttacaaagcccattagtcaaaatgagaacgataacaatggtgatgataatagcaacaccgggtaagattgttgcccaaggggcaagataaattaattctatataatcttttatcattgttccccattctggcgttggtcgttgtgcacccaacgaaataaaacttaatgcactaatatcaataatggcaatgataaatgctctgctggtttcatgaatataacgaataataatattaggtaaaatggtttcttttacaagttgccaattacttgcaccatcaagtcgtagcatcaaaatgtattcttttttcagttcttgttgtacggcttggtaaatttcatgaataaaatagggaagtaatgcaagcgtgatggcaagcattgcattgattaagcttggttgcattaatgtagcgataataatagcgatgagtaaaatagggattgataagaaaatatcaaaaaaatgtcctaagactcttgcttttaacccttgtgataatcctgcccaaataccaagaattccacccaaaatagatgtgaataatacaacaatgagggcggcaccaaaagtgtaagttgtacctcgaatcaaacgactaaaaatatctcgtccaatatcatcagttccgaaaaaataggcaatttttccgttatcagcccaagagggaggtagtaactcaaaaccaataaactgtgctgtatcactataaggtgcgataaattgactgaaaagtgcggtaataatgagtaataaaaaaagataaaagccagttaatgccaatttatcttggtagaaaaatttccaaatatgttttaatccttgtgtttcgcgaaattcttcaggttctttatctagcataccagttcttcttattaaatgggtccaaaataaaggataagaattcagtaaataaattcactgcaataatacaaagcccaacaacaataatgcctattgaaatgctattatagtcttgttgtttaaccgaatctattaaccaatgacctataccgaaccaaccgaacgtgctttcaatcagcatacattgagccataacaagagtaaataaacgactcatttgcgggatcatgataggtattgtgttacgtaaaatgtagatttgtagaatttttctttttgaccaccctcttgtttctgcaattttgacataactttgggtgaataaaaaatcagctcgttgctgaacgattctaataatatccatagttggcagaattgcgagaactaatgtgggcaacacaagatgttgcaaaacattttgaatcattttaatacgataaggctgatccgtaaaccaaacatcaataataggaaagcctgtaatgggctttatctcatacaataaattatactgtccaattgctgaaatttcccaattttgaatagctgaaaagtacaacaagattggtgctaaccaaaaaacagggatagcaatacctgtgatatagaaagaacgaatagctttgccaaacaaattatctgcatataatgcactgagtaatccaagaggaataccgaaaattaatgctaacagcattgcactaacacatagctctaatgtaggaggaagtacagcaaaaatcaattcttttagtgattctccgccgtggtaagtaataccaaaatccccttgtagtaaattttgtagatagaaaaaataccctgaaaaaaagtgcggtgttgctagcacttgatttaatggatctttgagcagaatgctgtaactgatgagagataaaataaacagcgtgctgataactaaaatgcagtgacgaaaaaaggaaaatagcattgttttattacctgtttataatttctattattttttaaatgacagttttgaaaaattaatattgccaaacggcgttaattcaattccctgtacttttgcattcgctaacagaacacgttttacgttagcaataggaagaatagggatttcggataaaataatttcttgtgcgatattataatattttgcacgttcacgtaagttcgatgcggctaatgcttgatctaaggcgtgttcaaaaggtgcatggcaccaatttgaaaaattagttatttcgttttgtgtaccgcaacttaaaatgggacgcataaaactatcagggtctagatttcctgctaaccagccagttaagataatatcgtaatcctcagtttgttcttgaagctgtttcattaaataagtgcgggtaacgttacgtatatttacattcaccccaaccttaattaaatctgctttaattaattcagccatttttattggcgaagggttatacacttgttcttcattaataacccacatatctagatttatattttttcctgcaaagtattcctttgcttttttgacattatagtcataggcaaaatcagttgtatttacaactgccccccaagatattgatggaataatattgttcgcaacacttgctgtattatgataaatcaggttaataatacgttggcggttaattgcatgagcaatatggcgacgaatctccagatcttgcataagtgttttttgaaagttaaatgcgatataagataaattcatgccttcaattgattttatataatatttttcatcattgtgacgcaataaccctaattggctcagttctggataagaggcgatatggcattcattattgaagaatttaattaatctgcctgagcgattagtggaaagatcaatgatcacgttttccaggtttacatttttttgccaataattagggttatgaacaagacgaacatattgattacgaaagtaatctttaacctgataaggacctgtgccgacaggtaaattatctaattgcactaaattgtcgtccgcattgagttgcaatgcgtattcttgagaaaaaataatggcgtattggctggctaggtgggaaagcacggaagcatcgggtttaaacaagataatttgaacttggtaaggattgattgctttcacttcctgaattttttcatttaatttaatgctgtcaaaataaggaaaatgcacttttttacgttgttcgtgatagaccttatattgtggatttttatagtgaagagtgttttgatctaattccggtagtgcgatattctgaccgagtatgcgatttaatgaaaaaaccacatcttccgcattaaaatcacggcttggtgtaaaccagtctgtatgatgaaatttaacgcctttgcgtaaattaattgtaataattttcccatcaggtgagatactataggatttggccaaaactggttcaagagttgcactatgatttttaatttcaaataatttattgtaaatttgctccgtgactatattcatactggttccggcatctgcagtttgaggattaaaggaaaaactgcttgcattggtacaataaatcaaaccgttgtcagtgagtattttgggtatttttggggcactaaaagagggcaaactaaagagtagcccatagaagagtgtacataatataaaaatcttttttgccaacataacttaattaattatgataaattatatgggaattgtaaggcatattaacgcaatatagaaataaaaatgtttaattttatccataaagaacttgatgaactcattaatcgtggaatggaccgcactttacgtattgccgttacagggctgagtcgtagcggtaaaactgcttttattacaagttttattaatcagctattacatattaattccattgacaataaacatcttccgctatttttacctgcacaaaataaccgtcttcttggtgtaaaacgtgttgaacaacgagatctcagtgttcctcgttttgactatgaacaaaatatgaaagcgttgaagcgtgagcctgcaagttggtttaaatcaacggagagtgtcagtgaaacacgtttagccattcgttatatacgtaaagatggcttaatgcgacatttaaaagaaaaaggcacattatatgtagaaatttttgattatccgggtgaatggttactggatctgcccttactggatttggattttcaacaatggtctttacagcaacaagagttatttattgagcaacgacaagaattagcacaaaactggctgaataagatccgcactttagatttaagtgagccggcaaatgaagagatgttggcacaacttgcccaagactatactgaattcttatttgcttgtaaaaaacagggatttcatttaacacaaccgggacgctttgtgctacccggtgaattaaaaggcgctccggtattacaattttttcctctggttcatttaactgagcaagagtggaaaagactaaaagagcggtctaaatctgacagttattttgcgatgttgagcaagcgttatcattattatcaacaaaaaatagtgaaaggtttttatcaagaatatttttctacttttgatcgtcaggtgattttagcggattgcttaacaccacttaatcatggtcgccaagcgtttcaggatatgcaaaatgctttacagcaactattcaaaaatttccattatggcaagcgaactttattcaatcgtttgttttcgccaaaaattgataaattaatgtttattgcgaccaaagcggatcacattacattggagcaatttccgaatttagtgagtttaatgcgtcaattagtacaagagggagggcgttacgtagaatatgaaggaatagatactgaatatactgcaatttccgccattcgttctactcaacaagtacaagtaacgcaaaatggacaaaagatcaaagcattacaaggaattagatcaatagataagaaaaaaattgttgtatatccaggaagtgtaccgagtaaattgcctcatgcagacttttggcagaagtatcattttgcgtttgatcaattcgaacctcttacagtggaaaatggtgagccaatcgcccatttacgtatggatgctgtcttacaatttttattagcagacaagttagattaggatataaatatgcaaaaaaaggtttttcaacaagaagatgttgagcaaaaaatcacagaaaattttgagcctaaacaagaatttgagcaagacgaattagatatagaaatggactgctctcaatctgaaacaacaatggatcggcaaaatacagatattcattttcagcatatggttagaccaaaagtgacaatgtggcaaaaattgctcatggctacgatctgtttgtttagctgtggcattttggctcaatcggtgcaatggttggttgatagttggcgggataatcaatggattgcttttgtttttgctatggtcagtttatttttggttttgttagggcttggagcaataataaaagaatggcgacgtttagttcaactaaaaaagcgtttgatattacaagaaaaaagccgagaaattcgctcaaaaagtgcggttaatttaactgaggtttcttctgagggcaaagagttgtgtttaaaaattgcctcgcttatgggaattgatgataaatcgccacaactcattgcttggcaagaacaagttcatgaagcttacactgaacaagaaattctgcgtttatttagtcaaaatgtactaataccttttgatcgggtagcgaagaaacttattagcaaaaatgccgttgaaagtgcattgattgtggcagttagccctttagccattgtggacatgttctttatcgcttggcgtaatattcgtttgattaatcaattagcaaaactttatggtattgagttgggctatgttagtcgtctccgtttgttacgtatggtttttgttaatatggcatttgccggtgcggcagacgtcattcaagatctcggtttagaatggttatctcaagatataacagcaaaattatccgcacgagttgctcaagggattggcgtgggcatacttactgcacgcttaggtattaaagcgatggaattttgtcgccctatagccgttgctccagaggagaaattgcgtttaagtcatatccaaacagaattattgggaacattaaagacgactttatttagtgccaataaagtgaaagagaaagtgcggtagaaataatttattagtttcaaaaagcaaagattatatacataaaatctgcactttaataagtctgttaaactgttagagtgcagattaaaatgaccaatttttactcttaagcgacaacattaaattgtgctttcatcaatgcttcgaaatctgtgcaaccgccaataggtttttcatcaatgaaaatttgcggcacagtttctactggtttaccgacagacaatgatagatccgctttactaataccttcagcaacaatatcaatataacgataatcgaagtcttcaagggtattttttaatttttctgccaagttttttgcacgaacacaatacgggcaacctgaacgaccaaaaataacaacgtacatatttattttcctttttgtcttgttaataaaagaacgaccacattgtaactcatttggggcaaaaattttagcattgttacaacgaaaaaaacctatttctatcaatatcagaaattatccctaactatcaataagttcaatagtcacaccattatgtaatcctctcggcagaggtgatcctttgcgtcctcgctcagcacgaaatttttgtatatcctccggttttaaggtgacttttcgttttccagcatgaaagacaagactggttttttcgctgatcaagaataatttgaccaataattctgaccgctctttagcatttgcagcgggaatatgaatgattttgttgcctttacctttggataattcaggtaagtcggcaacaggaaaaaccagcattctattcatggaagttaaagcgaccaaaagtgcggtagaattttgcaaaactaatggaggtagtacgttggcattttccggtagggaaataaccgcttttcctgccttattgcgagataccaaatcttcaaatttacaaataaatccatatcctgcatcagatgccataagcaaagattgattttcgttttctatcagtaaatgttcaatagtagcaccgctaggtaaggtcaattttcctgtaagcggttctccctgtgatcgggcagaaggtaaggaaagcggatctaaagtgtagctacgtcctgtgctatcaataaagaccaccggctgattgcttttaccgcaggcatgggtcaaatagttatcaccggtcttgtagctcaaagcccgtgcattaatatcatgtccctttgcacaacgtacccaacccatttccgataagataattgtaatcggttcgctcggtgtcatatctgtttcagaaattgcttttgcctcagcacgttctactaaaggcgataggcgagggcttgcgaaagttttcgcatcttgctgaatttcttttttaattaaattatttaagcgaatttcagagtttaatatttgctctaaactgttccgttcttttgctaaattatttttttcagcttgcaattcttgttcttctaatttggctaaatggcgtaagcgtaaatttaaaatcgcttccgcttgttcatctgttaaattaaagcgtgcgattaatatttctttgggtttatcctcggtacggataatttcaataatctcatcaatatttaaaaaagcgatgagtaagccttctaaaatgcgtaaacgagctaatactttatctaaacggtattgtaagcgacgagtcaccgtttgacgacggaaggttagccattccgttagaatttgaacaagattttttaccgccggtttattgtctaagccaatcatgttcatattaacacgataacttttttctaaatcagttgtggcaaataaatgagccataagtgcatctgtatccactcgatttgaacgaggaacgatgaccaatctaattggattttcatgatccgcttcatcacgaatatcttctaccattggcagttttttattctgcatctgctcggcaatttgtgccacaatttttgacggagaagattgatgaggaagtgcggtaataattatttcaccattttcttttttccagacggctcgcattttaattgagccacgtccctgttcgtaaattttacgaatttcttctttcggtgaaataatttccgcttcagttggaaaatcaggaccttgtagtgcggtcatcaattgatctaaatctgcattaggattatctaacagcataattgtggcatcggcaacttcattaagattgtgcggtggaatatccgttgccatacctacagcgattcctgttgtgccgttaagcagaatatgaggtaagcgtgcaggtaaatattgcggttcttccaatgtgccatcaaagttggcttgataatttaccgtgccttgtcctaactcggataataaaatttccgaaatttttgataagcgagattcagtataacgcatggcggcaaaggacttaggatcatcaggtgccccccagttgccttgaccatcaacaagaggataacgataagagaaaggttgtgccatcagtaccattgcttcataacaagcactatcgccatgcgggtggaatttacccaacacatcaccaacagtacgtgcagattttttatattttgcactcgcattgagtcccaactcagacattgcataaataatacggcgttgaacaggttttagcccatcaccaataaaaggtaaggctcgatccatgatgacatacatggagtaatttaaataggctttttccgtaaactggcggagtggcatttgttcaatgccttcgtagttgattgtgttcatatggttgtttttcgtttacttaatgaaaataaaaatgtatttaaactatgattttaaaatcatatcgtcaatattatcctgaaagacaaatttacgatgataatcaaggtatttttctcttccttcaggataaattcgcattttatttttcgcatttgggttgatatgcaatttctcccaagtataaatgcttagttgtgtaccgcagattagctcgccattatccgtaaatgtgatatatccctgatcaaataaccaatcgtatgtcggagtaagagataaaccattcaaatgatccaatgcctcattttcttttccttccgagatacaaacactgtaaggtttgatatggcttgcttttaataacacatcatctttaattaaagtaaatgggcattgtggcatataatctaacacttttctgcgatattctgactgtccttttcttcctgtccgtttaactgcacctttcttttcatcaattaatttttctgtcatttgcgatgatgattcagtaagttttggatgaacaatggatctaaattgataatctaaaaatactctgaaataaaacaaaggtttttgctcttttccttgaattttctctggaagtagtttcaaaatagataaatagctaattttaggaagaattaatgctcgccatatattccaaatatcggcatctgaacgaatataacctctacgacgtgtaggattaccagtgactaaatcagacacatcataaattgaaaattcatttatctcattttttaaatcaacaatagaatttaagtaatcattataatattcggaaatatctgtgtgataatgttgttcttgtttgtgaaattcaactctagcatcatagagatatttcaataggttgcttttactaaaaaaacaattttcttgaatagttggatattctgctctcttattgttaacttgtttagctgccccccattcatgatactcaaaaaaatcacttaatctagcaccgctattgccaacataactaccgacatattttcgtgcttcaccattccctgtaaaaatggataatttgtttttacgatgaataaaactatcttccgcacgtaaattttgaatagcatcaatgataatgtaattttcgccattaacatggattttttgaaatttttgcatattcctattctccgtattgtgtaatatccatttgttttagcaatgcgattaacacatcaacgacaatactatttcctgcttgtctgtatgtttgagtgtcgctgacgacaatttggaaatcatctctaaatcccattaaacgtaaacactctcttggcgtgagctttcttattcttccttgattatgagtaacataattatcgacgccggcacggtgcattttgtgcattgtttgtaataaaggacgagctactgataaatcagtttgtgtactcgttttgaaattctttgttccacctgctaaaacataatcacgaattttgctggataaataatatttttcttcgacatcattaatgttaaaaataaactcatcaaaactgcttttatttattttgggcacaaaaacaaaatcaccatgccaattaaattgttggttggctttttgacataacattatatcgccattaatttgcgtatagcgtttttgccgatttttagaactggttacaaatttaatgcctttttctttaagaaaatatttgctatcagtgtaatcctctagaaaatcttgcatcgtacgctctaaaggaatcttagttggaaattggaatccgccttttggcgaggttttaaatcctacaacaaaaatacgttcacgatgttgcggaataccataatttttgctgttcattacttgaaaatataaatcgtagcctaagctatgaaaaacatcttttactacttgccaagtatttccaccatcgtgatttaataacccttttacgttttcataaataaagacttttggttgagtctcatttaccactctcgcaaaatcataaaaaagcgtacctcgagtatcttccaatccatgtcgttttcccaccatagagaaagcctgacaagggcttccacccactaaaatatctacttgatcacggtaaggtatcgcatcaaaagtggtaatatcagaatgccaatgttcttcagataaatcgtaattggctaaataactttttttaacgtggggatcaatatcgccagcaaaaacaatacagtgatttagttctaaacgtttgaaagcttgttctattgcaccaataccactaaacgtcgtggctaagcgtatttttgcattaggatttttaaatgttttaaaacgccaatcacactcatcaaataagggtaattcaaaatttaggtttgttttatccacgagatttgtcatataaatataaaataaattttctatttttagagagtacttaaccaaataattcacacagcaaaatctacttgatcaccgttattttgcaaccaaattttccgatcttcggaacgttttttagctaataacatatccatcaattctaacgtagatacatcttcttcgtggggttcgtaggttaattgcaccaaacggcgagtgtttggatccattgtagtttcacgtagctgattaggattcatttcacctagccctttgaaacgctgaacattgagtttgcctctcttattttttaagcgtgctaaaatgctctctttttcattttcatcaagagcataaaaaacttcattacctaaatctatacgataaagtggaggcattgcgacataaacatggccatgttgaactaattttggaaaatgacgtaaaaataaagcacaaagtaatgtggcaatatgtaatccgtcagagtcggcatcggctaatatacaaactttaccatagcgtaattgagataaatcttcgttgtcaggatcaattcccagtgcaatagcaatatcatgaacttcttgtgagcgtaacacttgatctggtgaaacttcccatgtgtttaaaatttttccccgtaatgggagaattgcttgatgttcacggttgcgagcttgtttggctgagccaccggcagaatctccttctactaaaaaaagctccgttttacttaaatcttgttcactacaatccgctaattttccgggtaaagcaggaccactgactaattttttacgcacaactttttttgctgcacgtaaacgtctttccgctgaacttatcaccatttttgcaagttcttcggcatcttgaatattttgatttagccataaactgaaactatcttttacaacgccgccaacaaagaccgcactttgacgagaggaaagtcgttctttagtttgacctgcaaattgtgcatcgtgcatttttactgataacacataagcacagcgatcccaaatatcgtcagcggttaatttgacatttttgggtaataggttacgaaactcacaaaattcacgcatagcatcaagcaagccttgacgtaagccattgacatgagtacctccctgaatggttggaataaggttgacataactttcgttaagtaattcgcctccctcaggtaaccataataatgcccaacttgccgcttctttattcgtactaaaattaccgacaaaagggttttgtggtaagagattatagccattaacattttccattaaataatcagataaaccgtcttggtataaccaagtatcctcagtgttattgattttatcgataaatttaatttctaatcctgaacataaaactgctttagcacgcaataaatgacgtaggcgactgactgaaaaattagcactatcaaaatatttcggattaggtttgaagtgaacggaggtcccggttgtacgctttccgcaagtgccgataatctctaattcttctaccttaacaccgttttcgaaggcaattttatagatttcaccgttacgttttacctgaatatctacacgctcagataaggcatttactacagaaatacccacaccatgcaaaccacctgcaaattcatagtgcttattggaaaattttccgccagcgtgaagtttagttaaaataacttcaacaccggatactttttctgttgggtgaatatcgacaggcattccacgcccattatcaatcacctctagagattggtctttatacaaaataacttcaattttggttgcgtgccctgcaagtgcttcatcaacactattatcaataacttcttgccctaaatgattagggcgagacgtatccgtgtacataccggggcgaagttgaacgggttcaagatcttttaaaacggttatttcttgtgctgaataatttgtcataatgccatgtgatcagtaaaaatttggagaattttaacaaaaaaagtgtcacctttcatcttgattgttgtttatcttcttttgaattccaaggagcaacccagaataggcaaagcataccgggaatggctaaccagaaacaaaaccaaaaatagtcatagtatcccaagtagttgattaaaacgcctgcttgtgtattgaaggtaactcgaggtaaggcggcaaagctggtaaataaagccagttgagtggcggtataaagtggattggtttctcgtgccataaaggcgacaaaggcagacgtacctaagccaataccaatatattcagcggcaacgactaaactgagagaaatcagagcaaagttatctatttcctgaaatggacctaattttgccaaccatgcaaagcctaaaattgttacaatttgtacaacaccaaaaagccataatgcacgattaattccgattttcagcatgatgacaccacccacaatactggcgatgagcatcggccacaaggaagaatttttgaccactatgccaatttgggtcatgttataacccatatcgagataaaacggcgaaatgagggcggttgccatactatcgccaattttatagagaaaaataaaagcgagaataccaagtgcggaagacgtgcctttgcgtgtaaaaaattctttgaacggttcgatcacattctcttttaaagtgcggtcattttttagctgaatttgaggttctttacttaaaaataaggtcataaaaataccaggaagcatgaagagtgcggtaattaaaaagaccgttttccaaggtaaatagtctgccaaaattaaagaaagtgagccgggaacaagccctgcaatacgataggcatttacatgaatagaattacccaagcccaattcacgatcagagagaatttctcggcgataagcatcaagtacaatgtcctgacttgccgaaaagaaagacaccagtactgcaatacctgcaatcagttgtaaattaaaggaggagcttggttgtaaaaaaccgaataaagcgagtgaaatgagcagtaaaacttgcgaaatgagtaaccaacctcgacgccgtcctaaaaagggcggtataaatcggtcaagcaaaggagaccatagaaatttccaagtaaaaggaagcgttgtagctgtaaaataacctaaggtttccaaatctacgtgttctttacgtagccaaagtggcaataaggaaatgataatataaaaaggtaatcctgagctaaagcctgtaaacacacaaataagcatattacgactaaagatttgttgcagcattgagtgagatttttccataatttttccgtatgtataaattttttcaacagtatagatgattttttcatgttcatgataggatttttttattcacataacaagtagataaaatcttttacgcaaacgtttactatttgaaagtttcaggtaaaatacgcgcactttttttattcattttaacttgcctataggggacgctatgtctttagaaaaaacttttgagttgacgaaacgtggttctaacgtacgtcaagaaattattgccggattaacaaccttcttggctatggtttattcagtaattgttgtaccgaatatgctgagtgcagcgggatttccagcagaaagtgtgtttatagcaacttgtttggtagcaggattaggttcaattttaattggcttatgggcaaatgcaccgatggcgattggttgtgctatttcattaaccgcctttactgcatttagcttagtgttgggacaaggtgtgagtattcctgtcgcattaggtgcggtatttcttatggggatagtctttactttaatttctgcaacaggtattcgctcttggattttacgtaatcttccgtcgagtattgcacatggtgcaggtattggtatcggtttatttttgctacttatcgctacaacgaatgtgggtattattgtagccaatcaaaatggcttattagttaagtttggtgattttacgtctttctctgtgctgatgtctttggttggacttgctgtaattattggcttggaaaaaatgcaagtcaaaggtgggatcttatgggttatgatcgcaattacgatcgcagggcttatttgggatcaaaatgtacagtttaaaggcgaaattttcagattaccgacttttggtgaacaatccttatttttagaattggatattatgggagcattacaaccggcaattttacctgttgtttttgccttagtaatgaccgcagtatttgatgcaacagggacaattcgtgcagttgcaggtcaagcaaatttattagataaagatggtcaaattatcaatggcggcaaagcattaacagcggattccgtaagtagcttattatctgggacacttggtaccgcacctgccgctgtatatattgaatctgccgccggaactgctgctgggggtaaaacaggtatgacagcgattgttgtcggtatactgtttttattaatgctatttttccagccattagcaagtttggtgccaaactatgcaactgcacctgcgttaatgtacgtaggattattaatgttaagcaatgtcagcaaacttgattttagcgattttgttggagcaatgagcggactggtttgtggcgtatttattgtactaactgcaaatattgtaaccggaattatgctaggttttgcaactttagttatcggtcgtttagtttgtggtgattggaaaaaacttaatgtaggtacagtcatcattgccattgttttggttgctttttatattggcggttgggcaatttaattgtatataaaatgttaggtgggtaagcttagtcagctctcgaaagtatctacaaaaaaccggcgataacaacactgctatcgccggtttagttttatatgatgaattagttaaatacgccgctgatgccgacacggaaaccaactcggcctctactatcagaagaaatgccgccggatatggcatattttccgtttgcggaagttctaccgaggtttaaagagaccgcactttcgctgctataacgagcggcaccggcggcgtaagaccattttcccgggacgaaagggacttctttgaaagccatagcggcggcgataccggcttttgcgtctttgttgacctcttcaacacgttggttggtkgcrtgwarytgrctaccrttkaccgcatcrgtkgakygatgagaaagcaaaccggcagcaacattttgaatacgrcgttcattgcctttgtttcccacggaaacgacacctttcgcatcaacgccagcgtaattgccgtcgactttgccgataccgccggtagtctcgcctttttccacataagcggaactatcgcctaggaagacggagttattagtggttttatgaatattattacctacaacaacggtgtttttagaagtttgttctatgatgttattatgccccatagaaaaagagccctcagcgtaattattaatattagagccgattgatacaccattctcagcagttgtatttataccgctaccaaaacttaacgcacgtttaccagatgcctttgcttgaggaccgatcgcttgagcacgcacaccactcgcatctgctttccaaccaagagcggtagaaagttgtcctgtggctttagcatctcgaccaaaggcattagcccaactattagcataactatttctaccgatagccaaagatgaatccccattcgcctttgcttcatcacctagtgctactgcaaaatttcctcctgctttagaatgtttacccatggcaatcgcttgtgcatgtgcgtttgcctgaaaacccattgctacggcataagattgtgnnnnnnnnnnnnnnnnnnnnnnnnnnnnnnnnnnnnnnnnngcatctgcctcataacctacagcaacagcggactygccnacttttgagctttttccaayngcaacggctttgnnnnnnnnnnnnnnnnnnnnnnnnnnnnnnnnnnnnnnnnnttcaccaatataaatcccactgttttcaatcttaatatgattattactattayttgrytgttgaccttgagccatarccgaatkagcagytaaaacaasyaccgcagttaaagakaaataamawwttttcacttgaaataaatccttaaaaaaagagttaacatagaaaaatcataaaaaaacaaccgcactaagaggcgataatttatgacacgccttaaaaagaggtagggggacctaccaaagcgggcgaaattttaagcggggggggggtactgtcaatatatttttttacaaaatgtttacttttttaacaaaattgaaacggaaaaacatttgtcgaacacgaaaaaatattcatttgtttttgtgttatggaatgcagtagaaagaagaaagaaaaaatgaaatgataattggcggaacggacgggactcgaacccgcgaccccctgcgtgacaggcaggtattctaaccagctgaactaccgctccgcaataaaagaaataataaggggaaatttggcggaatggacgggactcgaacccgcgaccccctgcgtgacaggcaggtattctaaccagctgaactaccactccgtaaaagtggagtgcataataatagtgaatagatttttcgtcaagttatttttatttattatgcacttatttttgctaagtgttgattaagcaaacattaatgcatcgtttcttttgtatttcgcttaaaccataagcaattttctttgcttttttggtttagcaattttagataatcttggtgagccagtttttcttcttctgtgggtaaaagtaatttgaaattatgagtattggtagtatgttgatgaatattttcttccatcgttataatcggcgtatgttcttcatcaccaaataaactggtttgcccccctgtcatggctaaataaacatcacctaaaatttcagcatcaagtaatgccccgtgcaatgttcgtttactgttatcaatatttaatctgtcacagagtgcatctaaactattacgctttcctggatacatttgacgagccatttgtaatgtatctgtgattaagcaaatatccgctgtattgatattgaaattgtgttttttaaactcataatccataaaaccgatatcgaaaggtgcattgtgaataatgagttcagcccctttgataaaatcaataaattcctgtgcaatagctgaaaaatccggtttatctgccagcatttcatcagtaataccatgtactttaattgcttcaggatcaacgagacgatccggttttatgtaaagatggagttttcttcctgtgtagcgacgattgatcatttcaactgcaccgatttcaataatacaatgcccttcataatgtgcaccgaattcgttcattccggtcgtttccgtatctaggataatttggcgattttgtgtgatttctaatgtcatactattttgctgttgcttgaaatgaatttgcggtattatcaccccatttgagaaaaattagtagaaaattatgttaaaaaaaattgaaatttttaccgatggatcttgtttgggaaatcctggggctggtggaattgggattttgttgcgttataagcaacatgaaaaaaaactgtatcaaggcttttttcaaactacgaataatcgtatggagttaagagcggtgattgttgctctaaatagcctaaaagaatcctgttcagtgattttgtatagtgatagtcagtatatgaaaaatgggattacaaagtggattttcaattggaaaaaaaataattggaaaaccagttcaggtaatgcggtgaaaaatcaagatttgtggtgttcattggatcaagctattcaaaaacatcaaatagaatggcgttgggtcaaaggacataatggacatcgagaaaatgaaatttgtgatcagcttgctaaacaaggtgcggaaaacccaacgctggaagacgttgggtatcgagctgaatagaacaggctaaataaaactggcgagaaagcgtagtcgaaataaatgatttgactccaaaatattcgcctttatttttcaggtaatttcgcaatgactgcgtaaccttctttcaaaccttcaatttgataggtaacatcggcacaaataaatgcactctctccctgttttaattcaagtgcggtgtgatttgcggttatttttaatgcaccttgcatgacgagtaaaatctctgcgttacttgaggttagggtgtgtttttgttgcacgctataacgtacgtttgtcatggcaaaatctttagcgggcgtagtgtaagtaaagatgtcttgatcttgaggtgccttaggaataatttgaggcgtaatttcactgcaatcaactatttttaatagctcaccaatatccacatgttttggtgttaatccgccacgaataacattatcagatcctgccattaactcaatattttgacctcgtaaataggcatgcggaatgcctgcatcttgataaattccctcacctatattgagatgaacaatattaaataaatagaaacaaattaatccagcatccagtttatcagccggtatttccattgcttcaattgtatataaaacccaatagtcgggattatttaatttcagttttccctgtctataagcaacctgattttcagtaataataggggatagccacgcagaaagttgagtttgatcagcttgcataattgttgcataaaaactgtgtaagtcttgattttccagctgttgagcaagtgcggtcaaagatggacgggcttttaaggtttcaagaatgtttgttttttgtttgaaaccatgcaacagccaaaaatcagacaatgcaatcatcatttcgggtttatggtttcgatctttataggttcttttaggatcttttaacgctattcctgcaagattctcttgtgcaaaacctatttccgcttgtttttttgttgggtgaagttgaattgaaagcggctttgcaacatctaaaattttcagcaaataaggcaattcatgtccaaaattcgttagggttgctttccctaaaacttgtgggttttgtagtaagaaatctgttaacagtactgatttttccgacatatttaatagagaaggggatgaggaatgagcaccaagccaccattctgcataatattggttgtgttgtttttctatgtttaacaactcgggaaggtaattttgtccaccccaaacatagtgttgtagacgaccttgtagctgataaatggtattcattttgctgtccttttatttgataatgacttataaccgccgaaaaaatgaactattttttctatatcttgtaggttttctggtgaaatcatgagatgttttttattttttaactcaataatcagagtgttattttcaagcagattaatttgccgaattttagcataatcaatataaatattttcaaagaaaaaaccctgttctttcagtaataaaacaggaaagcgaataaaggctatatatagactgagaagaatgcttatcgctaagaaatagagggttattgcgttaatttgtcctgaattttgatagagaatgatggcaatgagtacaataaaaataagtgcatctatttttgctcgctttttcaaccgcactttcaatttcgttgttcctttaagatagtccatcataaattgatcgtaaaaggcataaagaaaaaaacagcaaatacctacaataagaaaggcattaaccatatattacattcctaaaatgaaaaacttctcccgtgcagggagaagttttcggataaattaagctaagatacctgttgcggcacctaaaataccgataataaagataccggtaataatccataatgcgttaatacggttgcgtaataaccacatacaggcaaaagtgaacaataacggtaataatcccggcatcaaactatcaagaatattttgtacagtcgttgtttcaattgtgccgtcttgtttttcaataacggatacgactaatggtacattaatactggtccatttctgcactaaagcccccataatgaacaaaccaagaattgatgcaccttccgtaagtttttgcaacaatccgccactcatatcctgaacaacgtccaagccttttttatagccataagtaacaccatagtaacgtgtcgctaaacgaactaaattgaatagcacgaagaataaaataggacctaaaatacttccattgatcgctaaacctgcacctaatgcagcaaatacaggtcttgcagtaccccaataaattggatcaccgacccctgccaaaggtcccattaagcctactttgataccgttgattgctgcatcatcaatttctttaccgttcgcacgttcttcttccatcgcaatagtaacgcccaataccggtgcagcaacgaaaggttgcgtattaaagaattctaaatgacgtttaattgcatctttacgttcttgcgaatttggatccggatataaacgtttgatcacaggaaccatagaataggcaaagcctaatgactgcatacgttcgaagttccatgaaccttggaaaatgtttgaacgaagaacaacggcatttaaatcactttgggttacttttttcatttctgttgtcattttttggattcccattaatctaatctgttatctaaatcattattgttatttgctacaacttgtaccactttactttgattgtatttcgggtgaagctgaatataaagtgcggccatgattgcaccaagtacaccaagagcaacaaggttgaaatcggtaaatgctgcaataacaaaaccagcatagaagaatggcattaaatgacctgcacgcatcatattgatcaccatggcataaccgacaaccgcaataataccaccggcaatttttagaccgtttgttacgactgctggaatagcgtttaacatatcttgtacaacatcggttccagctgtcaacgcaacgacaagtgcagggattgcaatacgcattgcttgtaataatagtgcactacgatgaatccaatctaagcgggttaagttaccgtcttcaattgatttatcagcagcatgttggaagccgacagttaacgcacgaacaacataggttaatacttgacctgctgcggctaatggaatagcaattgcgataccggtgctaatatcttgtccaccgacaataactaagattgttgaaacaacggaggctaaagcggcatccggtgcaagagccgcaccgatattcatccaacctaacgccaagagttcaagtgaaccgcccacgataatcccagtttttatatcacctaagactaaaccgattaatgtacaagcgattagtgggcgatgtgtttgaaattcatcaagaattgatcccataccagagatacaggcaacaataaagacaagtacgacttgtaaagttgaaatttccatttatgtcttccttaaattaaattattttttttgagtaaatccatcatatattgacgactgtcgttagatactttacgaacatctaattcaatgcccatcgcatcaatggctttgaatgcggcaatatctttatcatcaacagccaccgcactcgtaatcatttttttaccgtctttatatgccataccaccgacattaattgatttcatatcaacaccggcttctaacaatcttaaaacatcggtaggattagtgaataatagcatcatacgttcatttgcatattcaggattgttatatacacggatcattttttctatattcacaacatgtgcggtaactcctggaggtgcaacgcttttcagcatggttgagcgaacttgatctttggcaacatcatcattgactacaacaatacgtgttactcgactttcttttgtccagcgagtggcgacttgtccatggattaaacggtcatcaatgcgagctaaacctacaatgagattgccttcttgttgtttgactgcgatttgaggttgttcagggactggttgtgagagtgcggtagtttcagccgatttttcttcatatttcaaagcacgaacaccagcacggccggtttctaacgcaatgctcactaattcttgtaagctagggttatcgtcacgtgccataaaagtttccactaacataggcacatttacaccggttacaatatccatattagtgttatcaccaattacacgatttgccgcattaaacggactgccgccccaagtatccactaaaaacaggacttcatcgcaatgtgctaatgttgtacttaatttttcttgatacttcgtcataatcgtttcagcattttcgcctgaaacaaaatcaatagttgcaacattctcttgctcaccaatcaacatttctgttgttttaagcaattgttcagccgcaacaccatgcgttgctatgataatcgcaatggacattcggactccttcctaaaagtattaaattgatttaaagggcaggtattctaaaggaagttttattttaataatgtgatacagatcacattttaagatgttttttgggtttaaagtgtgatgtaaatcacgctgattgcaaaaaaaagtcaaataaatgtgatttagttcactctttactcgacttattcaaaaatgcacaaacaatcaatttaacgtactttagcaagattgtttttttgagtttttaataattcagcatgtgctttcttttgctcttttattttattgttaatttctctacgctgtttagacagttccgcattacgaattgtataatcgtcaacccgagtttcgtaatcatcacgcatactttcaataatcgcacgcacatcagcaatactcatatcattacggatatattgattcagattatccaataacaacacacgcttttgattatcacgaattttacgattattgtcgtctatgtcgcgtaaaagtttgttttttaaccgatacatacgtacatactctaaaacttcttggaaagattgtttattgatattttccatttttttcttctcttttattaaatgaaacttcggctaatttaactttttttcccttattcgtcaaagtgttctctaggaattttcttgagctgtaaaaaattcagaaatttattaaaagttagttgattaagctgtgacgagatgatagaaattaaaaattctttttataaaaccaattaggataaaaatatgatgcaagtatttaattttagtgcaggacctgcaatgatgccaaaagttgttttggaacaggcacaacaagaattgttgaattggctggatcagggtacttctgtgatggaagtcagccatcgtggtaaatattttatggaaatgattacacaagctgaaaaagattttcgtcaattgtataacattccggaaaattacaaagttttatttttacaaggtggggcaagagggcaatttgctgctattcctatgaatttagccaataaaaaaggtaaaacactttatcttaccagcggacattggtcggcaactgcggctaaagaggctcgtttgtttacagaggttgatgaaattaatattttacttgatgggaaattagaagtaggagaacttgattttagccacattgcttcacaatatgattatgttcattattgtccgaatgaaactattagcggcgttgagattgttgacgtaccaaatgtaggtgaggcgatattgattgctgatatgtcttctaatattctatcccgtgaaattgatatgagtaaattcggcgtaatttatgccggtgcacagaaaaatctcggtccggcaggtatcactattgtgattgtgcgtgaggatttaattggtcaggcaagaaaagaaacaccgtcaatttggaattatgaagtccaaagcaaaaatagttctatgattaatacgccgccgacttttgcttggtatctttgttctcttgtattcaagcatttgcttgcactgggtggtgtcaaagaaatggaaaaacgtaatcaggaaaaagcaaaattattatatgattttcttgatcagagtgatttttatcataatgttgttgcacctaaaaatcgctcattaatgaacgtaacatttaccacaaataatgatgaacttaatgcgaaatttgttgcagaagcgacagcttgtggattgcaagctttaaaaggtcataaggtattaggtggaatgcgagcttcaatttataacgcaatgccgattgaaggcattaaagcattaattgaatttatgcgtaaatttgaagcagaaaataactagaattttatagcaaaaacgaccgcactttaacggttattaatttcaaataaggatttttatgcaatacatcaacatcgccaacgaaggcgtaaaatccctgtctccttaccaggcgggaaaacctattgaagaattagaacgtgaattagggattagcaatattgttaagcttgcctcaaatgaaaatcctttcggttttcctgagagtgctaaacaagctatccaaaggcagttaaatgatctcacacgctatccggattccaatgggtttgaacttaagcaagtgatttcgaaaaagttcggtttgcaaccagaacaaattactttaggtaacggttcaaatgatttattggaattaattgcccatacttttgcttcggaaacagacgaaattatttattcgcaatatgcttttattgtctatcctttggtgacaaaagcgattaatgctgttgcacgagaaattccggcaaaaaattggggacatgatttagacgcttttttacaggcgattaatcataaaacaaagttaatttatatcgctaaccctaataatccgacaggcaattttttgactgaacatgaaatagatcatttccttgctcaagtacctgaaaaagtgcttgttgtgctggacgaagcctatacagaatttacagatgaaaaagagcggttaaattcttttaaacttttacaaaaatatccaaatttaattgtttctcgttcattatccaaggcgtatgggttagcaggcttgcgtatcggttatgcggtatcgaaccctgaaattgcggatttacttaatcgtgtacgtcagccttttaattgcaatgttcttgctttagtttcagcggtagccgtgatgcaagatgatgcttttgttgaaaaagtggctgaaaataatcgtattgaaatggttcgttacgaaaatttttgccgacaacaaaagttagattatattccatctaaaggtaactttattactattgattttaaacgtccggcaaatgaaatttatcaagcattgctacataaaggggttattgttcgccctattgccggttacggtatgccgaatcatcttcgcgtcagtatcgggttaccgaaagaaaacgataagttttttgattcattagtaaaagtgttaggcgaggtctttgttgggtgaagaaaagtaatttatacttttgcaatatccctatttacaacttaagaaagcaacataattttatggaaaaattaacgttatctccaattagtcgcattgacggcgaaattaatttaccaggttcaaagagcttatctaatcgagctctgttattagccgcacttgcaaaaggaacgacacaggtaacaaatttattggatagcgatgatattcgatatatgttgaatgccctgaaagcattgggtgtgaattaccaattatctgatgataaaacggtttgtgttgttgaaggtattggcggtgcatttcaatggcaaaatggattatctttatttttaggaaatgcagggacggcaatgcgtcctttagcagcggcactttgtctaaaaggtgatacggagtctgaggttattttaaccggtgagcctcgaatgaaagagcgtccaattaaacatttagtcgatgcgttgcggcaaaccggagcaaatattcaatatttggaaaatgaaggttatccgcctcttgctattcgtaatcaaggtattttcggcggtaaggtacagattgacggatctatttcttcgcaatttctgaccgcacttttgatggctgcccctctcggtgagggggatatggaaattgaaattttgggggaattggtttctaagccttatattgatattacgctggcaatgatgaaagatttcggaatcaatgttgagcattataattatcagcgttttttgattaaaggtaagcaatattatatttctccgcagacttatttggttgagggggatgcttcttccgcttcttattttttggcggcagcagcaattaaagggaaggttaaagtaacgggaattggcagaaattccattcaaggtgatcgtttatttgcagatgttttggctcaaatgggggcaaaagtaacttggggagaggattttattcaagttgaaaaatcagagttaaaagggattgatatggatatgaatcacattccggatgcggcgatgactattgcaatcaccgcactttttgctcagggtgaaacggttattcgtaatatttacaattggcgtgtaaaagaaacagatcgactaacggcgattgcaactgaattgcgtaaactcggtgctgaggttgaagagggggaagattttatccgtattcagcctcttgcattggataaatttaaacatgttgaaattgttacttataacgaccatcggattgcgatgtgtttttcgctcattgcattatcagatacatcggtaactattttagatcctgcatgtactgcaaagacttttcctacctatttttccgagtttgagaaaatcagcaaaaatcaatagattaatgggcaatttattgcccgtttttttataattaaattctatattcaatttgtgtaataagtaaaaagtcattaaaatgggcgagtgtttattcaattcttgtaatattttattcgattatcgaaaaaaatccgctttgtgtaattactacgccggaggctgtaattcagtatggtgatgaacattttttaatgttaaagattttatttttttccgttaggagttagtcctcatgagtattcaaactcacataaaagcaaaacgttctcatgtgtttttcttaaaactatttttgggcatcattgtgcttttatttgccattatgatcggtttaaaagttgcttcaaaaatgcttattggcaagatgatagccagtatgcccgaaaaaacgacaccggttacggcaattacagttgtaccaactacctggacacctgttatcgaaacaacaggcttggtgagacctaatcaaggtgcggttttgagtgcacaagcaccagggactgttgcaaatatatttatccaatcaggacaacctgttaaaaagggagatgtgttggttgagttggatatttctgttgaacaagctaatttacaggcatcagaagcaaaattaaccacagcaaaacaaatctataaacgctatctgaatttgtataaaacgaagagtgtttctcagcaagaattggataatgcaaaagccaattatgagtcgttggtagcaaatattaacgccttaaaagcagcaattgagcgtcgcaaaattgttgcaccttttgacggtattacaggtattgttaaagtgaatgttgggcaatatgttaatgtgggaacgcctattgtacgtgttgaagatacaagttctatgaaagttgatttttctattgcacaaaatgagttggaaaagttgtttattggacaaaaagtgacgacaacaagtgatgcacgtttaggtgaaacgtttggtgcaaaaattaccgcacttgaaccagcagtgaatgcagcaactggtttaattgatgtgcaagcaactttcgaagatgaagacagtcgtaagttactatccggtatgtttatgagattgcgtgttgcattgacgaccgaaaaagatcaaattgttattccgcaagtaggtattagctacaatatgtatggtgaaagtgcttatgttttgaccgcactttctgaggaagacaagaaaacattacttgataacgaaaaatttgcttataaagacagtatagacagggtttatcgagtaaaacaaactactgtatttactaaagatcgtcagggtatttatgcacaattaaaagggcaagatattaagccaggtgaccaaattgtggttggcggtcagcaagctattaccaatggtagtttagtggtggttgttgataaagaaacaataggcacacaacaacctgccaagaaaactaatctttaattttaggtaggaatatatccaatgaaatttaccgatatatttattcgtcgtcccgtattagctgtgtcaatcagtttgcttatcattattttagggttgcaagcaatttcaaaattgagtgtacgtgaatatccgaaaatgacgacaacggtaattactgtagcaacggtatatcctggggcagatgctaatttgatgcaggcatttgtaacctctaccttagaagaggctattgcccaagcggataatattgactatatgtcatcaagcagtgcggctaattcttcgataattacagttaaaatgaaactgaatacagatcctaacggtgctttagctgatgtattggcgaaagtgaattctgtgcgttcaagattaccgcataatatagaagatcctgtgatttcatcttcaacaggtggtacaggaattatgtatatcagtttttattctgataaattggattccagtcaagtgacggattatatcgaaagggttgttaagcctcagttatttactattgaaggggtagcgaaagctcaaattttcggggcggctcaatacgcattgcgtatttggttggatcccgaaaaaatggcggcacaaaatctttccgcactggctgtaatgtcagctttatcggctaacaatgtgcaaacagcggctggaagtgcggatggttattataccgtttataaaaataaagtcgggacaaccactaattctgttaaggatttagaaaatttaattgtttattcaaaagacgataatcttgtacgtttgcgtgatattgctactgttgagctaaataaagaaagtgatagtacaagagcaacagcaaacggtgctgattctgtcgttttagctattgaaccgactgcaacagccaatccattaacggtagcggaaaatgttcgtccattgtatgcacaaattaaacagaatttaccaagcagtatgtattctgatttgctttatgatcgtactatcgctatcaatagttctattaatgaagtgatcaaaactattattgaagctactgttattgttttggttgtgatcttactatttattggttctttacgtgcaattttaattcctattattactattccaatttcattaattggcgtaatcatgattttgcaattatttgatttctccattaatttgatgacgctattggcaatgatcttagctattgggttagtggtagatgatgcgattgtggtattggaaaatgtggatcgtcatattaaagccggtgaaacaccgtttcgtgccgcaattattggtactcgtgaaattgcaatacctgttatctctatgacaattgcattgattgcagtgtattcacctatggcactaatgggcggaattacgggatctttatttaaagagtttgctttgacactggcaggtgcggtctttatttcaggcattgtagcattaactttatcaccaatgatgacaagtaagttactaaacaataatgcaaaacccaatcgtttggaacagcaaattgaaaaatcattaactcggttaaccaatgggtatgtttatgttttaaatttagttatggctaaccgtaagtgtatgcttgcttttgctgctattatttttgccatgttaccatttttgtttacttccctttccagtgaattgacaccagcggaagataaaagagcatttatcgctattggttccacaccttccaatatgaatgtagattatgctcaggaggcaacgaaacagtatgttgatctgctgaacaaaacagaagaagtacaatttacaatgtctattgccggttttccaagttctagcgatacattaaatgttgtaaccttgaaagattataaagaagatggtcgtagtcagtcagagattatagaagagttgaatcgaaaggcaacgcaaattccggaagtgagtgtttctgcctttaattttcctgaaattgatacgggagaatccggagcaccgataggctttgttattagtacagcaaataactatcgtgatttagcaccggttgcagaagcatttttagcgaaaatgcgtgaatcaggcagatttgtttatacgaatctcgacttaaagtttgataccgctgaaatgcaaattagcatagataaagaaaaagccggaagttatggtgtttctatgcaacaaattagtagcactttagggagctatttatccgcagctacggtaagtcgtgttgatatagacgggcgagcttataaggttatagcacaagtcaaaagagcggatcgtttaacaccggaaagtttgaaaaacttctatgtatcagcaagtaacggaaaaagtattccgttgagtagcctaattactatggaattggtaacacaaccgacatcattgtcaagatttagtcagttaaactcggcattaattcaagctgttccaatgccgggagtttcagtaggtgatgcggttcaatggctgaaagatgcagcgacggagttactgccaaaaggatataactatgattttcgtggcgaagcacgtcagcttgtacaagaagggaatgcgttagtaataactttcgtgttagctgttcttattattttcttagtattggcaattcagtttgaatctattcgggatccattggttattatggtttctgtgcctttggcggtaagtggagcgttactggtacttaacttcttgagcttattaactgatatgagaattttacggttatcaggagttaccctgaatatttactcacaagtaggattaattacactggttggattgattactaaacatggtattttaatgtgtgaagtagcaaaagaagaacaactttatttgggtaaatcacgaattgatgccatcactgaagcggcaagagtgcgtttacgccctattttaatgacaacagcggcaatggttgctggattaattccgctcttgttggcatcgggagccggtgcggcatctcgttttagtattgctatcgtattagttgcagggctttcaataggcactttatttacgttgtttgtattgcccgtaatttattcttatattgccagtgaacacaaacctttacctgagtttgatgaaagtataaaaccattggcgactgatcagcatcattaaattcaagcgataaataaccgcacttttaagtgcggtttattatttcaactattttatttgcaaacgcaattgggttttctaaatgagcattgtgtccggcacgttcaattaaaaataaatttaattgattttcttgtgccattttcttaaatttttcatccttttcaccacagaaataataaataggcagagaaaaagaccgcacttttttatgaaaagatggttgtttggcaagtgacgttgcgattagcatttttgcaatattttgacctgattgatgtcttcgttgagaaattaattgttttctctctcgtgcagataggtgagcaaaaacaggttgctgataccaatcatttaaaaccttggacatagtttcttggctaaaacgttttgcccaagccaaatcattctgccagcgttcaaggcgttgttgttcattttctacgcctaaatttgcaccttccaagataagtgcaacaagtttactttgtggatatttagattgcagtgcgtaatttaaggcaagacgtccccccaatgagtaaccaacgagaatataaggcttatcggcaatttttgtggtaatttgtcgggatagatattgtgcactttgttcaaaatcttctatgtgatagtttgtttgttcaccatgaaagggcagatctaaacatagataagattgtgaggaaaagtgcggtagattttttttaagttcttcgataatgtattgccaatcttgttttgttccaagtaatccatgtaaaaaaactaagatcggcatcatacgctatacctcttaaacaccgattaatgcatgaccaattttgtcaataagatctttatagatattactaccatcatttggattgactttaatttcgatgatggtcgtttctctgcgtgagtaggcttgtttaagtaccgtagccagatcagcccaagtataagggcgagcatatttgagatcgaacatagctgcaatatgtgaaaactcaagatagtgcgacatacggtaatatttttctttcactgcgatatcaacaggaagcatatcaaagattgctccaccattgttattaatgacaaagataattgccggttggtttagttgtttgaataatgcaaaagagtttaagtcgtatagcgtggaagtatcgccaatcattgctaccagtgtttgttcggaaccaacagcaattcctgccgcagtcgcaagcaaaccatcaattccacttgctccacgattagtgtaaattggataattggcggaaggttggcttagtgcatcggcaaggcgtacaaataaactgttccccaaaaagagaacgctattagattttggtagtaataattcaatattatgtgccaatgaggcctcatttaaatttgaaccgacacgttgtttgataaattctgcacagaatttagccaatgctaaaggctcgagtaaccaaggttttttccgcattggcggatgggctcgtaaccaatgatgcggtttagcattgaaacgtgtatgagcatgatgatagggatcaacagctttttgattattttcaataatccagtattcacctttaaattctgctaagaattgattaattcgctttccaataaatcctgagccaaattgaatgacgatttcagcttgtaacagtttttttctgacagtttggtttgccagccaaatatctgcataaggtagggttggtttaacatgggattgaatgtctgtaatcattatccaacccatattttctgcccattcagcaattcccattgcctgttcggaaggtaagcgtccaacaataattatgccttttttggttcgccattgatcccaatatttatgtgtaataacttccgtgtgttgttcttgatgttgaatccaatttttgttttgtgttagccaagattgaatattactgagccaaggatgaagatctatttcatcattattggcattatagagcggttcagcaaaagggacattgatatgaataacacccccttgcttttgtcggaaacaagcctgatctaaaactgaaattagccattgagcagaatagttttgacttggacgaggcagatttatgctggcgatcgggtattgtgcaaacatattttgttgcaaaatagcttgatttgcaccgcactcaagcaattcaggaggacgatctgcagttaagataattaatggcacatctgtttggcgtgcttcaataattgcagggtaaagattagctgttgctgtaccggatgtaacgattacagcaaccggttttttgctcgctttagcaattcccaatgcgaaaaatcctaagcctctttcatcgaaatgagtatgacaggtgccacgtccgttttcctgtaaacggatagcttctagtgtaagtggtgtggagcgtgaacccggtgcaatacaaaaatgagaaacaccttgacggctcaaggtttccaaaataacttttgaccaacaacggttaaaaacgctggctgacatattttctactccgtttctttctgtaatagggatattagccctagtgctttacgttctatttcttgccattctaataaaggaatagaaccttcaacaataccggcaccggcaaatatacgaatataatcttgttcaataaatgagctacgaatagtcacacaaaactcagattctgtttcagtcattattcccaatgcacctgcataccaagtgcggtcaaaagtttcggtattttgcaagaacacttttgcttctttttgtggtaaaccggcaatagctgcggttggatgtattgcatttaaacataccgcatcagtatttcctgctttaagtcgggcagaaatttctcgttttaaatgttgaacttggcgtagttgcttaatttccagttcactcaccgtaatttcctcaacatagggtataagatgttgacaaatgccctctacaaccaagctgttttcataaatatttttcggatcttgtaataaccactgagcttgttgctgattaatatgttcatcatttgttataaaagctgtccctgccaatgcttcagtgattaggcgattttctttacgaacatataatctctcaggcgtggagcctataaatgcttgtgtattattttgagcaaacaaaaaatgatagcaacctgtattatatttctcactttcggctaaaaaatccttagcgtttaatgggctatcagttttaaagtcggtttcatttgccagcacaactttagtcagatttttttgcttaatttcatgcaatgctttttctacccaaagacaccattctgtttgatttgcttttgttgttatcaattgaatagattgatgaattgggtttaattgaacttgtttttccaaagaataaataatattcaacagatcatatttttcttgttcccaaggttttttattatcaataatgagttgaataacaagtttttgttcttgtatgaatgataaacgtggcaaaataaatagaggttcaccattaaattgacagccgccgataagagataaattaaattgttgcacaaacgtttgtgctgatttaacttgcgtaaagcgacatatttctccaagccctaagatttttttattggtatcacgaaaattaagataaaattgcggataatgatgttgagcttttaaccaaccgagtaaattcaattcttcatctaaatccaaatgaaggacggaaaaatcgtttttagggtcaaattggtattgattaattaagcgaataaactcagccttaatctcgtgcaaattatccattttgtatcgtattaagttaaacattcagttaaaaacagctcttaattctaccgcactttaaaaaatttttttataaaatcttttcatctttttaaaataagcgtaaagtgtggctatattttgagtgacattattattaaaaggatagtttatgcgagttttccctaaatccgataagttagaacatgtatgctacgatattcgtggaccggtacatcaagaggcgttacgtttggaagaagaaggcaaaaagatcttaaaattaaatattggtaatccagcaccattcggttttgaagctcctgatgagattttggtagatattttgcgtaatttgcctgccgcacaaggatattgtgattcaaaaggtctatattctgcacgtaaagctattgttcaatattatcaatctaagaatattttaagtgcgaccgtaaatgatgtatacatcggtaatggtgtttctgaacttattactatgtcattacaagcattgttgaatgatggtgatgaggtgttaatcccaatgcctgattacccattatggacggctgctgcaacgttagccggcggaaaagcggttcattatttatgtgatgaacaagctgattggtttcctgatgtggcagatataaaaagtaaggttacttctcgcacaaaagccattgttattattaatcctaataatccaacgggagctgtttatagtaaagaattattattagatatagttgaagtagctcgccaaaatggattgatgattttcgccgatgaaatttacgataaaattttatatgacaacgctgttcatcatcatatcgccgcattagcaccagatttgttaacggttactttcaacggcttatcaaaatcttatcgtgtagcaggatttcgccaaggctggatgattttaaatggaccgaaacagcaagcgaaaggctatattgaaggtctagatatgttggcctcgatgcgtttatgtgccaatcatcctatgcaacatgctatacaaacagctttgggtgggtatcaaagtatcaatgaatttattttgccgggtgggcgtttattggaacaacggaacaaggcttatgagttgattaaccaaattccggggctaagttgtacaaagccaatgggagcactttatatgtttccgaaaattgatactaaaaaattcaatatctatgatgatgaaaaaatggtattggatttattgcgtcaagagaaagtgttattagttcatggacgtggttttaactggcaacaaccagatcattttagaattgtaaccttgccttatgtgaatcaaattgaagacgccttaggaagattagccaaatttttaacgcattatcgtcagtagttgtgaaacaagagagaacattttgctctctcttgttttgtcttttaaccttcttcacaaaaattttcaggtaaatttgtcagtattcctttccaaatagcactactacgttcacgattttcaacaagataaacactggcttgttgataatctccatttcgacaacattctttcaattgttgatagaaagtgagttcaacttggcgtgattgcggattaataaaaaaaagtgcggcgacttgatgataaagtgttctaaaactgtttaaaatcaaagtatatacgggcttatccgatataaagctaaaacgatgatagaggttatagtcaaattccgcataactcttttcatcatcatttaattcatctaaagattggaaaaattcaaacgtttgttgaggattaatttttattgcttcaggaataaattgttcacccattcgagtacgtaaagataccacatttgcaatgacggtaggtttaagagtaggtgataattgaatgagtgtttttaaaatgttgggaccagctgtttcccaaatattgtttactttggttggtttaccatgttgaatatttagccaaccatcacgattcaaacgctgtaatacttcacgtaatgttgttcttgttacaccgattttgcctgctagttcacgttctgcaggtaaatctgagccggcaggaaaatgattattccaaatgcttttgacaatatattcttcggctaacgcagccggactttgtgctttaagaatatccatacttctctttttgttaaacatactgtaataactaggtgggcattatccttgaaagcgatttatattacaatcatttaattatgttttttgctttcctttataagtgttttattctatattactcgtgcgtttgtatttttgtgttttgagtttttatgaaattaatttgatgacattaaggatcataggcatgctcatcttttttaaaaatttatcaatgaaacgtagtacttggatactgctgttcatttcagcattagtgttagaaagtagcgcactttattttcagcatggtatggggctgaatccttgtgtaatgtgtatttatgaacgtgtagctattttaggtatcctgttttcaggattgattggatttattgctcctagaggcttagttttgcgtatattagctttattaattggattagggagtacaataaaaggattattattagcaatcaaacacttagattatcaacttaacgtatacccttggaatcaatgtgcaatggttcctgattttcctcaaaccttaccattggataaatggtttcctaatatatttatgccttcaggttcttgcagtgatattacatggagttttttaggattttctatggtgcaatggattattgttatttttgcatgttatttcctatttttcattattctcagtataagccaatttaaaaaagtcagaaaaaacagaatgctgtttagatagctctgctcgttgaaatttttctcaaagtgcggtgttaaaatacattatttttgtaccgcacttatgttattaaaaaatcattctttaaagcttacttattcctaacgtgaacgcatctcctttagggggattagacgtagggaaaatcaagatttaataaatcttatagattattttgtgtctaagatctttagcaaaacgctttaacttacgtataaacggtacgttttcaactttccattctttgggcggattttcaagttgccggaataaatgacaaaataaattcgcttttagcattgaacatttttcatgccatgatttttttggaccaacataatgaataatagcaagaggcatagtcgcttcttcatattgattcagttcttttttacttaccctttttagtctatttaatgcattggcagtaaaattatatcttaagtctaaatattttacattattcgcaaaaatagcatttaaaatatcctgatcttgatacaaaaattcaatattattacgttcacaatattcaatccattgtaatgatttttcaaaaacatgacatttttcccattcaactacattaattaataatacgccggcattaaaataaaaatgtgtattaggtagatgaagttttgttttataatctgactgactgactgactgactgactgactgactgactgactgactgactgactgactgactgactgactgactggtcattcgtttgcttgtttttcgattttcaatccaagcatcataacaagctccgatcgccttgttttctaaatcagtattccacaaaggtaacaggctatgattgaccaatatatcaatatccaaataaataatttttgttaaattaaatttttttaaataatttaccagatttaatctagcgtaggttgataatgaaatatattctatagtttttggaaaattttcaaaatcacttatattaataggaacaatatttaagctacaattatttttattggctaattgagtgcaataatcctttgcaacattagatattcccatatccagtaaataaaaatgaatagtataaaattcattgtttttatctctggatttaataatactcaacattgttacggctaaatattttgcataattgtcatcacatgaaaagagaatattcatttgtttcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattttctttttactcttattctaaatcgccctatttccttcgaaatacttcgccataaactttttcttgcttttttcctttgttctctctctctctctctctctctctctctctctctctctctctctgcacgctctactgaaataacgctggttaatttacagttttctttatttaaaataaaatcytgnanaagaattgcaggatcwagytgataaacrggatattgytcttcttttaataatgattcaaataaaatgacatcaatwggmtmaattgaaatatygggagwttkaaataargyyaataattttytwgctgcaaattgygaaataatataycctgctgtwccccaatgtaraaamaktaaytgatgaaacctacgttgttgraaagrttgaattttagtactgcggtatattgattgcattgaatgagtttctaaacgaagaataaaatattgaytaaaatcgaaccgctcttttaaccaatcatattgcccaagaaattggtgggcgactggactgagaataatgtcatcttcaaaaatrgcrataaarggtarattttcatcaacacatttttgccataatagaacatggctcataaracagcctttttctcctattgtcagatcrgttttatttaargaagggacatattgttgaatrrtatkttcattttcttcattmggttgaaaagcatcaaaaaaggaatatggaatattttgyttgcyaaattctttttcaatatgttkacgtcgttcaatcgaactttttaarctaataacataattaaacattttctttcctaaaaataaagtaacgtattctaacaatgatatgctatttgcagagatattattataagaattttacggcacgccaacctctcaatatcctttttctaaatcgccctatttccttcgatatacttcgccataaattcttgtttgcttttttattatttttactctctctctctctctctctctctctctctctctctctctcgggtgcaagagaactggttaatgtgcagttatctttatttaaaatacaatcctgaataataatggcaggctcacattgataaaccggatattgttcatcttttaataattgcttaaaaataatttgatctatttcttcaatgaaaatatccgtatttttaaataacgctaataattttttagctgcaacttgagaaagaatatagcctcccattccaaaatgtccagacattagccgattaaatttacggttttggtagtcgggaatttttgtcttgcaatattctgatttcatataaattgtttctaagcggagaataaaatattgattaaaagcgaaccgctcttttaaccaatcatattcactcaaaaatttattggcgaccgaactgagaaaaatatcatcttcaaaaatggcaataaacggtagattttcatccacacatttttgccataataaaacatgactcataaaacagctctttagtttatttgcgagactgcttttacttaaagctgggacatagtgttgaaggatattttcattttcttcattaagttgaaaagcatcaaaaaaagtatagggaatatgttgttggctaaattctttttcgatatgttgacgtcggtcgaccgcactttttagactaataacataattaaacatagtttactcattttttatatataaaatgtagtggtttgctactcaattaaattgacagtataaaaaataatttctaaaatagccaatattttgttgaagttactgtgaattatgttagataatgccaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcagcgatttttgtcataaatttagaaaaagcaactgaaagaaaacattttatttcccaccaatttaccgcacttcaagaacagcatcctgacatcgtaataaattatcagttttttaacggggtaaatggaaatactcaaccaaatcaccctttgtttgctaaatataatcaaaagaaacgttattatcgtaaaggaaatgaaattactttagggcaattaggttgttacgcaagtcattatttattatgggaaaaatgtgttcaattgcaacaacctattatcgtattggaagatgatgctattttacagcccaattttttagctgtttatcagttctgcttttctgcggaaaatcaatttgaatttttttggttaacgcactctaatagttcaaaaattagaacaaaattaattcacacgttacccgatagtacaaaattagaacaacattatttcggttatagtaacacgacaggttattatcttactcctcaagcagcacagaagtttttagactcttctcaagaatggatatataacgtagacatttttatggatcgtttttatgaaaatcatgttgctttattaggcgtaaatccgccttgtgtcaaacccgatttttctaagcaaagccagattacgatgaataaaaacaaccgcactttttgggttaagttaagacgtgaatattttgcacttcttgagcgtatcaagcgttttgtttattggacgttttattgttgatgatagatatggataaagtgctaggtttacgagcagacaaaattggaaacaaaataggcagggaaattattagaatttccagttcaaattgatctgacagtcagctgttaaacagagactgtcagattagttgctttttatccttgtttgtttagtaaaaagacgccattttcactaaaatgaacgtaggcctcgtgcatttcttgtgaaaaattctctgggttagcattgattagtaaatctttaccgccccaattagctatgatttcccaataacttcccatatagaccgcactttttattacacaacgttgttcttccataccttctgattttagtttgactgcctcaggacgaatacccactaaacattctccatcgttcaaagcgaatttatccgcatcaggtaaaacaaattgatagtcgttaatggtaattttgccttgttctaaatagccattaaaaatactactttctcccataaaacttgctaggaatagagagttaggatatttgtaaagctcttttgcgggtgccttttgcatgattttacctttattcatcacgatgacttcatcagataccgcaaaagcttctgtttgatcatgagttacatataaagaagtaatatttagacgctgttgtaattcacgaattttttcacgcattgaacggcgtaaattcgcatctaaattacttagaggttcatcaaataataacactttcggctttaatactaatgctcttgccagtgctactcgttgttgttgtccacctgaaatttgatcgacatagcgatcttcaaatcctgccaagtcaactaattctagtgcctcttttactctttgtttgcgttcatcagaacccacaccttgcatttttaagccatagccaacgttatcgccgatggacatatgcggaaacagtgcataagactggaatacgatacaaatatcacgattttggatggaagattttgttacatcttcaccatcaataaaaatttctccctcggttggactttcaagtcctgcgactaaacgcaataccgttgttttaccacaacctgacggccctaataaagttaccattgaaccacgttttatgttcaagtttaaattatctattactacggatttaccaaacgatttggtgatatttttgagtactaaaaaatcattattcatatttatagcctattgttaaaattttttatttttctaccgcacttcgttattcaagtgcggtaccgattaattcatttttttcgcttttgaacgggaaatgcgagtgtcaccaacgatccagtcgaagaataaaataattgccatcatcacaacaattaaaattgaaccataagcaatggctatgccatattcgccatcttcaactcgattcaaaatataggcagtagctactcgtgtatccgctgtaactaaaaaaacaatcgcactgacggttgtcattgctctaacaaagctggtaaccagtgcggaaagcaatgccggttttaataatggaaaaacaataaataaaatagtttttaatgaactgccttttaaagaaagtgaagcttcatctagagatttatctaattgtccaagtcctgcaaccgccgctcgcataccaacgggcatgttacgcattaccattgaaagaataataattagccccgtacctgtaaggtaaatcggtgcatcattgaatgcaatgatataagaaacaccggcaacggtacctggtacagcaaagcaaagtaaggttaagaattctaaggtttttttgcctttaaaatctcgtcttactgtaatatatgcgatgagcaatccgaaaatagccgtaattggagccgcacttatcgcaaaaataaccgtttgaattaatgacggccaagcaccatcactgaagccttgaccaaataacgttatgtaattttgtagagtgaacgtgtaatcaactccccagttttttgtaaagctaccataaaaaatactgccatataagaccgcattaaagaggatccaaaaacctaacgtaaagacaacgatatattttaaggtcgttggtaattcttgtacgtctcctcgataggattttcccgatactgttacataagaacgattacctatccaccaatattgaataataaatattgcgagagaaaatatgagtaatatcgtacctaacgtgctggctgaagcataatccaattgagaacccgcaatgtaaaaataaatttgtgatgaaatcacatcaaagctaccgccaagaactaatggcgtactaaaatccgccaatgattgaattgccacaactaagaatgaatttgctaatgctggctttaacaacggaaaaataatattaaaaaacgtttgatagcgatttgctcttaatgtataagatgcctcttcaatagatggatggatagattttagtgcaccttctaaaatcataaatgacatgggagtaagtgctaaagtatgagcaattacaatacctgtaaaaccatatagccagttactgctaaacccaaaatactcaactaaaaatgaagttacataaccggaacgaccaagcattaatgttaccccaagaccgactacaaaaggtggcgtaacgataggtaaaatagagaatattttgcctattaccgctgttcgcttagcaactctggtagtataaagtgcgaaaattaacccaaataatgtcgctagagttccaattgtaaatgcaaccgctaatgagtttccaatgatgcgtaaaacatagggtttactcacaatgtccaacacttggctaggtacaaatgtcgagccatcgtagaacatagaaaggaaaatggcgaaagttggataaacaataaagaaaaatataagtaaaatgatacttattagagaaaatataatgaacttatctccttgcataaatttcatttttgccaatgcgttggttgctaatgcaaccaacgtaataaccaagataaaaatggaatatccaagactgaacttttgcaaaatagcagacaaaaatacaaaaaagaagattcctacaacagcaaaaaattcaacttttccttgtttttgttccccgctatgttgaaataaatgagaaagtattggcacaatgagtaatgaaccaaaccaaagccaacttaaattaaacttagtccatcccattgcgtcataaatttcttcagatgtagaatctgttataccatagtgtaatgtcatagttggtaacacaaaaaatccaataaacgacaataaaatccatcctaggctacctttgaatattcgtgtctgttcactcataaaacctccgtgaaacaaaaattactttgctaatttaacttctgtaacccatttatcaataatcttgctgcgaacttcatttgatccaaatcgatcaaaatcataatcgattaagtttaattccgttggcttaagtgaataaggcgatggttcagcattagcattagttggaatatgatgggattgtgccttttgccaagaaagttcttgagcttcttttgacattacccagtcagcaaataattttgcatttttcaaattacgtgcatttttaatgatactgattccgcccagttcatagcccgttccttcacaaggaacaacaagctcaataggtgctccatttgctttttcaaaagagtaattttgtaaaaagcctacacctattgctgtttctcctcttgctgtatttcttgaaggagctgtacctgctttagggtattgggatacatttcgatgaagttttttcaagtaattaaacgccgcatcttctccccataattggataaatgttgcaattgccgtgtaagcagtacctgaactttgaggatcagctaattgaatttcgttttttagccgtggatctaagagatctttccaacattttggaacttcagtaatacctaatttttttaacctttcggtatttacaccaaagcctaatactcccatgtatacaacagaactctttccatttcctaatttttgaaattgaggaagcacttctgccaatttcggtgatgtgtaaggttcaatcagacctagttctaccgcttgtaagtgcgtgtcgaatggaccgccaaaccacacatcggcttgaggattatttttctctgctaacatttttgctaaagtgctacctgaactattgcgaataaatgatgcagtaacattgtatttttcagaaaaaccttgaacagctttttcgcagactatattttgagcactacaataaaccactactctccctgccgattttgccaaggtttgagcgtgaaataaacttgcaaaaaataaagcggaaagagataaagcaaattttgataacttcatacttattctcctaagtaaaaaatatttttatttagccaatttaacttcattaatccattttgtaattaaacgtttacgttctgcaacgtcaccatatttttcaaaattgtaattaataagttttaatttcttaggatcaaaagctaccggtgattgttctgctgtcgtgttagttaatgtttggaatgattttccttttttccaagctaattcttgcccttcttttgataacgcccaatcaacaaacaatttagcattttctaagtttcttgcacctttaataatactgacacctcctaattcataccctgttccttcacaaggtataatcatttctatcggtgcaccttgttgtttttgcaatgcataatcatgtaagaaacctattcccacagctgtttcaccacgagcggtattattagagggggtaattcccgattttgtgtactgtgaaatatttgggtgtaactgtttaaaataatcaaaagctttatcttctccccaaatttgaataaaagttgcaatcgctgtataggcagtccctgaactttgtgggtcagcgatttggatttctcccttaagacgaggatcggttaagtctttccagcattttggaatttcagtaatacctaactttttcaatcgttccgtgttcacaccataacctaaaatccccatataaatggcagaagtataattacctttcactttagccggatcttggaagcgttctacaatatgatcaatattggctgaacgatatggcgttaataatcccatttcagctgcttgtgcttgaggatcaaacgtacctccataccatacatcggcttgaggattatttttttcagcttcaatttttgctaaagtactgcccgaaccattgcgaatgaaagaggtttttacattatatttctcaccaaaagctttggtttcagcttcacacatctcattggttgcactgcagtagacaactaaacgcccctttgcattaacttgagtcgttaccattaatcctgttgcaaaaagtgcggttgatattgcccaagatatttttttcattttcatatggttctccttgtttgaaaaatacctgttgtaagacagtgtaggaatgataacacaagaaaaaataggatcatgtgaggaaagtcacacaatacaaaataaaagggagtgatacataaatcttctgagaatgactgtcaatacaggtaaattttctttataatcggcataaattttcgtttaaagtaggtggaatattatccatgtcagatcagtcttgtattattattgccattgctggtgcgtcagcatcggggaaaagtttaattgcatcgactattcatgaggaattgtgtaatgaattaggctgtgaggaaattgggattgtgacggaagacagttattacaaagaccaaacgcatctttcttttgaggaacgtattaaaacaaattatgatcatccaaattcaatggatcgtgatttactaattcaacatttatgcgatctaaaaaagggtaaagccgttgatattccagtttatagctatgttgaacatacaagaacccaagaagtaactcggtttgagcctaaaaaagtaattattttggaggggatcttgttattaacagatgagcgtattcgtcaggaggtaaatatgtcggtttttgttgatacacctttggatatttgctttattcgccgtttacaacgtgatatggaagaacgtggtcgctcattacagtctgtcattgatcaatataaatccacggttcgtccaatgttcttacaatttattgagccatcaaaacaatatgctgatatagttgttcctcgtggtggcaagaatcgagttgcgattaatatgttaaaagtgcaaattcaacatttgttaaataacaaataaggaacaaatatgagattatgtgatacagatattgagcgatatttggatcaaggtattatttctttaacacctagaccgagcaacgaaaaaattaatggtgcaactattgatgttcgtttgggaaattcttttcgtgtttttcgtgaacatactgcacctttcattgatttaagcggtcctaaagaagaggtaaccgctcaacttgatgcggtaatgagtgatgaaattattattggagagaatgaagctttctttttacatccgggtgaattagccttagccacaacattagaagcagtcaaattacctgccaatattattggttggttagatgggcgatcttcgctggctcgtttagggttaatggttcatgttaccgcacatcgtatcgatccaggttgggagggaaaaattgtcttagagttttttaattctggaaaattgcctttggcgttacgtcccaacatggtgattggtgcattaagttttgaagtattaagtggtactgctgcgagaccttacacaagtcgcaaagacgcaaaatataaacatcagcaaagtgcggttgccagtcgtattagtgaggacaagtaagggtatatctgattatgtggaaaaaaatcttcttttttattaccgctctttttgtcggcatagcaattttcacgtatgtgcagattgaaaaaattcaatcaacgttagtcgcaagattaaatgctaaccaaatagcggttgacaacattactattgattttttccctacaaagataacgcttactaatctccaatattctaaacatccttctcacattaatattgacacggcaaatattgaaataagcgtattgaatttattagcgggtaatcttgctgtaaaaaatattgttctaaacaacatttcccactcatatccatctttcccagctgttcagtacttaacaatgatagggaaaattacacaacaaaatagcaacattttctttgataatgtgcagctggaactgcaatttgctcaccctgtttatttggataaaagaacatttaattttcatattattgaaggattttttaatcaaaatgagatggagactcctaaatttgaaggaaatatcgtcataaatcagcaacctgtgctcattaaagcggagatctatcaatcaaaaaacgaggaaaagggactaaagattttgtttaaagcttgggattgtgagcaatgtgcggcagagtttgaatataattcaactcgtgatctttcatcgctgtttacagaaggaactttgcaatttagcagtcataattttcccattgaatattggcttaaaatggcagatttagatccacttataacaggaaaagctgatattgttgcgagtggtgtagtaaaaaataatcggttacaaaaactggacatgccaattacggttaaacaaggatctctatccggcgttaatttgttggagttggcgagtgggattttacctatcaattacgatagagaaaatgcaccgagggatatggcttttgaacatcttcaactcaacgcaaattgggagaataacttattgtatttagaagatatatttattttgactgagaatattattattgagggcaagggaatttccgatcttgatcagatgcaatgtgatattaatttagttatgcgaccgaccaataaaaaatatcaaaatgtcagtttaactgtacatttctttgatcagtgcaatcgccctcagtatcaattgaaaatccgagcaaaagattatttaaagcaattactaaaaagaaaattttcccattaagtctcatgttaatcatgcagtcttgtactgtgctgaaaaaataaactcaattttaaaataaagtgatatttactatacactttctttcttacctttataaaattattgccaataaatatcttttcaagataaaaatctaaaaacaattaaaaattggaattaaataaatatttaattatatttaaaagcaaaaactcaaattaaaatgctgaaaatgacattgacttaaccataaaatttcctcattattgggtaagtaatttatgaggaaaaagttatgtttttattaaaaaagttcagtcatcttttagcaaaatacaccgcacttgttatcattgcattagcttgtgttactttttattccccaaatctttttacttgggtaaaaggtgatgcacaaattattgtactcggtctaataatgctatcaatgggcatgaccttaggtaaagaagactaccgtattcttgcaaaacgtccttttgatattttagtaggaactatcgcccaatatagtattatgccttttgttgcaatttctattgcacaactctttaatttgtctctagggttaactttgggtttagtgttggttggttgttgtcccggtggtgttgcttcaaatatcatgagctttctttgtaaaggcgatgtggcttactctgtgggtatgactactgtttctactattttagctccaataatgaccccacttttattgaattatttagtaggtgaaacggttgcaatggacggttgggcaatgtttaagtttatgttgttagtaacattggttcctgttggtattggctcaattatgaacataacgtttgaaaataaaaaatggtttcaagagttgcgtgaattaatgccgggtgttgcggttattaactttgcttttattgttggtggcgttgttgcggtacatggaaataaatttttagaatccggttttataatttttgtatgtattgttttccataatgttattgggtacatcttaggtttctttacagggcgtttatttggaatgagtacagctaaaaaacgcactttatctattgaagtaggagtacaaaatgctggtttggcaacaggattaagttcaacatttttcccaactaatgcggagtctgctattgcttgtgcagtatcttgcgtatggcattctatttcaggcacaattttagcaaatttatttttatggtgggataaacgcaaaaatacatcaactcaagagaacaatcctgctaaaaatttaatgaatagcacgaaataaaataataaaaatttatactgcacttgagtttgtaagctaatcaaggtaatgtatgcgagtttattttattattgttttatgaggttaatatgaaaatcattcttttgggggcacctggtgcaggcaaaggtactcaagcacaatttattacaaataagtttggcattcctcaaatttctaccggtgatatgctacgtgctgcaattaaagctggaagtgaattgggacaaaaggctaaaatcttaatggatatgggacaattggtacctgatgatttgattatttctttggtgaaagaacgtgtagcacaagaagattgcgagaaaggttttttacttgacggtttcccacgtacaattccacaagcagacgctttaaaatccgttggtatcagtattgattatgtattggaatttgatgtgccggatgaagttattgttgagcgtatgagtggtcgtcgtgttcaccctgcttctggacggacttatcacattgtttacaacccgccaaaagtggaagataaagatgatataaccggtgaagatttaattcttcgtgcagatgataaacctgaaactgttctagatcgtttaaaaatttatcataataccactaaacttttggttgattattatcaagctgaagctgcacaaggtaacacgaaatactttcgattagatggtacacaaaaagttgaagaagtgagtcaagaactggacaagatcttgagctaagtgcttaaatagttcagacctctatgactactcaatactgagaacatagaggtctgcttttattcattgaatataaatatgctaattattgtgcaaccattaccatggcaggtctgataactcgcccatttaatagatagcctttttgtaaaaccactgtaatttgattactttcaaatccttctgttggttgcatggaaatagcttggtgtaattcagggttaaaagtttcgccaattacaccgacaggttcaacaccgaagcgtgcaacagttgataaaagtccttttaaagttaactcaacaccatcgactaaacttttgatggtttcattttctacattagcaggagtagacagtgcacgttctagattgtctatcgtttccaacaaatctttagcaaatttctctaaagcaaatttatgtgctttttcaacatcttgttcagcacgacggcgtatattatcaatttcagcacgtgtgcgtaacaaaatatcttgttctttttttacagcttgaataagctgttcttccagttcttgcacacgagcaatagcattttccaacgcatctccatcctgtatttcggtttcttccattggtttttcttgctcattttgagtttcaagttcagctgaaatttcctcttgttcgactttttcttgttctgacattatttttttactccattgttagatttgtatcattgtatcaaaaaacatagaaattaacacccgcacttattggcaagtagagtagaatgtgtgtaatatagtactccttttatttaattcaagtgttctttgtagaaagaccatgacaccagcaaattttattgatagtaaaaaattaattatttcgtttaagacgattgccttagtaggacgccctcgtcatgatgtgaatttacaaatgcacaaaaatttatttcattggctttctgaacgtggttatcaagttttagttgaacgagaaattggtgaacgtttaggattgtcggtaaatcatttagcggatttagatgaaataggctgtttagcccatcttgccattgttattggtggtgatggtaacatgttaggacgggcgagagtcctagctaagtataatattccattaataggtattaatcgtggtaacttagggttcttaactgatattgatccgaaaaatgcttatgctcagttagaggcttgtttggaaagaggcgagttttttgttgaggagcgttttttacttgaagcaagtattgagcggaatggagaagttgttgcacaaagcaatgcaataaatgagacagttatttatccggctaaaattgctcatatgatagattttcatgtatatattaatgataaattcgcattttcgcagcgttcagatgggctgattatttccacaccaacaggttcaactgcgtattctttgtcagcaggaggtccaattttaactccgcagcttaatgctattgccttggtgtcaatgtttccacatacgttatcttctagacctttggttattgatgctgacagtaagatttcggtgcgttttgctgaatataatacatctcaattggaagttggatgtgatagtcaagtagcactttcttttacccctgatgacattgtacatatcacaaaaagccaagataaattacgcttgttacatctaaaaaattacaattattacaatgtattaagtacaaaattaggttggcttaaaaatttagcttaaaaaatttttataagtctatttactgtatataaaaacatatatataattgtatttatatacagtaaaggattcatgctatgttagttcaacttaccattaataactttgcgattgttcatcatcttgatattgaatttgcgaaaggtatgtcagttattaccggcgaaactggagccggaaaatctattgctattgatgcactcggactttgtttagggcaaagaacagagttatctatgttacgtgacggacaagagagagtggatgtttgtgccacatttcatattgagagcattaatcctgcttatcaatggctacaagagcaggagttacaagattctgacaaccctgaatattgcattttacgtcgaattattaattctgatggacggtcgaaggcttttattaatggtgttgcagtatcagcctcacaactcaaaactattggacaatatctgattcagattaatggtcaacatgcttctcaacaattgctaaaaagtgactaccagattcatattattgatcaattttgtggacatgaggacttattgaaaaatatgcaagaaagttaccgcacttggcgagagttacaggaaaaagtaacgacatttcatcagaaatgtgctgaaaatgaagcaaaaaaacagctattagaatatcaagtagaagagttagatcagtttaatttgaaagaaaatgagtatttggagttggaagaagagcatactcgcttatcaaatagtgaagaattgatttctttatctcagtcaacattacagttattaagtgaaaatgagagtgtgagtattgatagcctgctttataaagcaacacaatatattgatgagctttgtcaattggattctaattattctgatgtgcaaacaatgttgcaagaggcacttattcaaattcaggaagccacgtctgaaatgcaacatttatcctcaaatattgatcaggatccaaaactgttacaggctgttgaacagcgtatgggacaagtgttacaactcgctcgtaagcataatgtgaaaccacaggatttagttgaattacataaacaactgaaaaatgaacttgagcaactcgttcacttttctgaaagtgaatcgcaattgatacaacaagaagaacagatgcgacaacatgtgcaagaaattgcaacgaaacttagcttaagtcgtcagcaaggggcaataaaattatcaacacaagtgacacaatctattaaattacttgctatggaaaatgcggagttctcaattacttttgatgaggataaaaaacttacaagtaaaggttatgatcaactctgctttaatttgagagcaaatctaggtcaatcagtacaacctttaaataaggttgcttccggaggggagctttcacgtattgcattggctatacaggttttaacctctgataaagcagctgttcctactttaatttttgacgaaattgatgtgggaattagtggtgctacagccagtgttgtgggtaaattattgcgacaattgggtgaaaaatgccaagtcatttgtgtaacgcatttacctcaagtagcttgctgtggacataatcattttgctgtagaaaaacaggttatagaaaataaaacaataactaaaatgaccgcacttacatcagaacagagagttattgcattagcaaaacttttgggggggcaaggcattggtgaaatggcattagctaatgcacaagaaatgttggatttagtcaatataaattaaatttcatttcgtatatttcaccaaaacagattatattatatccgattttagatctgatctattaataacagactctagcctcagtacataaaaatgcttatgaagtaaatagctgatactgtttcacttatattaattctattgtctgaggtagagaaaaccatacagcacggacttcacatcgatgtttttaagtctgattttttaaccctatataacctcgtttttgcaaagttgcttctttggattttctgatcattgtttctattgtcgtgccttgaattaaaattgaaaagagaacaacgctgtaagtaataataataaataaatctcgcacattcataccgatattttctaaaaatgcactcgttgcaggaatagaaagtgccatggcaagagagagaccgcctcgtaagcctccccaagttaaaattcgtaaagtataaggattgtacacagttttcatacttaagaatttgaatgggatccatacgcttgcataacgacaaaacaaacataccggaatagcgattagacttaagatgatcgcttgtgaagtaaagttcaccaataacatcgcagagccaattaataagaataaaagtgaatttaagaaatgatcaatcatttcccaaaagtgatcaagatagtgttgactttgttctgaaaaaccggagtgtcttgtccagttggaaatcataattccggctacaaccattgccaaggcaccagaaatatgaagcaaatttgctaacataaagccagcagtaggaatggttaaagtgagtaagatttctaaacttccgtcatcggtagctgaaatcagaaaatgagcaataacacctaagattaagccaaagaaaattccaccaacggcttcagctaagaagagttttgtaatctccattgcagttggctcatgtccaccaaatgcaacggtaaaaatagttgtaaaaataactaatcctacaccatcattaaataaagattcaccttctactttcatggataatttttttggtgcttttaagtttttaatgatggccaatacagcgatagggtctgtcggagaaatgagagcaccaaataaaatacaataaataaaatctatatgcagttttaataaggcagatattccgtaaaataaaactccaataaagagagttgatgctatcgttgaaaacaaagctaatattgtgatctccaatttttggctttttaatacaggtaatttaattcccaatgcaccagcaaaaagtagaaatcccaagatgccatttaataggaaatctttaaaatcaatgcgttgcataacgttttgagcaatgtcgtctaaatggaataaattagtggatcctgcgattagtaatatcagtgaacctacagttgctgttgcggtgattgcaattgtgtattgaatacggtcactgattttttgagtgacaaaaccgattaaaatcgatatggtagagagaaaacaaatgtaagtataaatactcataagaagtaccttctaaaatttaaaaatctgtttatattttattaattaatcaaattagtaaaatataaacagacttgacttgttctaattgagatagtcaagtagcgattgagcattagaaagttaataaaatgtaacaagaaaaatttttgcctagtataagtaaagtcctactttttataaagttcatttttataaaataattagaaatagttaatttatagcgttattttcgaccgcacttttgatatgaaaatgcttgtttaaggatagtaatggcagaataaattttgtttgttctgccattatatgttgaagaatgaaaaattaacattttgccacaataacaatttccactttccatttcgggtcagccaattgactttgcactgtggctctggtcggtgcattatgagaatcaacccattcatcccatgccttattcatttcttgatagtcttgcatatcagctaaaaaaatttgtgcattgagtatgttgcttttatcggaaccgatttctagtaataatttatcaattagacctaatacttcttttgtttgtaaataggcatctacattagtattttccggtacttgtccggcaaaataagcagtattattgtgaatcgttatttcagatagccgtccgttagaatgaaagcgttgtattttttccataatgtctccttagtgaataatgaaattatgtataaagattatagcgatttttgtaaaaatggactaggatctgcaagtttttcttgaattattgtagtggaaaattttgtgtgaaaatgctgatttctaaccaacatggtgcaactttaatggcattaatgccatttttatatggtatgcttttggctaaaccgacttggcagcattcctttttatttttggcttggtttagtctatatttaatgagctatcctttttttcatttgttcaaaggtaaaaaatcgaattttataaaatatcaaaaatacacattgatttatggcacgacaagtttgatatttgcactacctgttttttactacaattggcacattttatattttcttatcgcaatgttaccttttggcttcatcaatatttattttgtaaaacaaaaaaatgagcgagcattaattaatgatttggcggggataattatctttgctattgccggtatggcaagctattatttttctacttttacctttactcaacaaatttggttagttgctttattgccaagtttgtatttcatcggcactactttgtatgtcaaatcttgtttgcgtgaacgaaaaaatcctaagtatttattggcttcttacttgtggcatgttgcttgtgttgttctttttgttgcaatacaacagttttatcttgcatttgcttttgttataccagcaatacgtgcctattttttaccgaagatgaagatctcagctaaacaactcggtttaattgagattgcggtagcccttgtattttttattcaacttctttttgccactttatagagaagaggactactatgaaattactaatgttatgtcgagaacctcgcctttacagttgtcagcgtttaaaagaaagtgcggaagataatgggcatcagatagatattctggatcctaatcgttgcttattaaaactctcgaaaaatgcaccgcactttgagttgtattatcaagtgaatagtaaaagcgagccgtatttattaccggattatgatgcgattattcctcgttttggttctacaagcacaagaatggggtgtgccgtgttacgacattttcgtacaaaaaatgtattttgtttaaatgatgatgttgcgtttttaaaagccagagataaatggcttagtttacagttattgactgaacaaggtattgctgtccctaattcagcattgtcaggtgcagaattttctgccactcaagccattttgcaaattcaatcgccgacgattttgaaaacgttacacggttcacaaggaataggcgttattttggcagaaaatcgtaaaagtgcggtgagtattatggaaactttaactcaagcagacgtaccgttattaatgcaggattttattcaggaagcacaaggaacggatattcgttgttttgttattggtgataaagttgttgctacaatgcaacgtattggacaagaagatgaatttcgtgccaattttcatcgagggggaagtgcagagaaaattcagttaaccgaacaagaaaaagtactggctttaaaagcaacgaaatgtttagggctagatgttgcaggtgtcgatttgatccgttctaaacaagggttgttagtgctagaagtcaatgccagtcccggattggaaatgatcgaaaaaaccagtggaattgatattgccttgcaaatgatagttcacattgaaaagcagtttaagagataatgttttactcgtagtgcggtagaaaaataccttgttttttgttttaataatgaaatttaaaaaatcccgatatttacaaaggattcacaccttaacatactgaataaataggttaattatgttcttttggtatcaaaatcacgttatagctaagttacttgtttggctgttattcccattttctttggtcttttggtttatttctgttattcgtcggagattatttcgattaaactggctgaaatcctaccgctctcctgttcctgttttgattgtgggtaacttatctgtggggggaaatggaaaaacacctgcaacgatttggttggtaaaacaatttcagtcgataggtattaaagttggcgttatttcacgtggatacggtagtcgagcagagcattatccatatttagttaaaattgatgataatccaactcgttccggtgatgaacctttgttaatcgcacaacgcacaggcgtacctgtttgtatttccccgaatagacaacaagcaattgagcttttactggcacagtttaattgtgatttaatcattagtgatgatgggttacaacattataaattacaacgtgattttgaaattgtagtgattgatggcgaaagggtatttggcaatggttttgttatgccggcaggacctttaagagaattaccaaatcgtttagcggaagtggatttaattattaataatggaaagctaacaggttatagtaatacgttaatgctcttattacctaaattcgccgttaatttagtcagtggtgagaaaaaactattacgtgattttcaacgtattcctctcaatgcaatagcaggtattggttatccccaacgtttttttaatatgttacgagattttgcgttaactcttgaaaaaacgcaaagttttcaagaccatcaggattttgatgcagcacatttcgcatatttctcttcaaatcaaccgctctttatgacggaaaaagatgcggttaaatgtcgtccttttgcacaggcgaattggtggtatgtgccggttgaggctgatattcagggagaagaggtagaacgatttatgcaagttgtttcacaacaaataaaggagaaaaaatgaacggaagattattagaaattgtcgcatgtccaatttgccaagggcgattgaaatacgacagtgaaaatgagcaacttatttgtcaccttgatcatattgcttaccctattaaacaaggtattccaattttactttccgatcaggccataagtttgtctacatctttaaccaatcctgagcaacaaaatcagtaataaggagaatattcatgaatttcacggttattattcccgcacgttatgcgtccagtcgcttaccgggtaaacctttggctgacattgctggaaaaccaatgatccaacacgtttgggaaaaagcacaacaatccggtgcaacaagagtagtcgttgcaacagattatgaggaagttgcacgagcagttcgtggttttgatggagaagtttgtatgacttcctctcagcataattcaggtacagaacgtttggcggaagtgatagaaaaattagctatacctgatgatgaaattattgtgaatattcaaggtgatgagcctcttgttccccctgttattgtgagtcaagttgcacaaaatctacaaaaatatcaagtgaatatggcaactcttgcagtaaaaattgaagatgtggaagagttatttaatccaaatgtagtgaaagttttaacagataaagatggttatgttttatatttttctcgtgcagttattccatgggatcgggatcagtttgttcaactgggtaaagcagatttatctcaattgcaattgcaccaacattatttccgtcatattggtatttatgcttatcgtgccggctttattaaacaatatgtacaatggcaacccacaacattggaacaaattgaaagacttgaacaattgcgtgtcctttggaacggtgaaagaattcatgtggaattagcaaaacaagcgcctgccgttggggtagatacggtagaagatttagaaaaagtgcggtctattttatctcatgtttgatgccaaaaactttcttgccaatgtcacgcaccagcccggtgtataccgaatgtttgatgaaaaagggcaggtgatttatgttggtaaggcaaaagatttgaaaaagcgtttatccagctattttcgcactaatttgaacagtaaaaaaacttccgcactggtttcgcatattcattcaatagaaacaacaatcaccgcttcagaaactgaagcattattgcttgaacataattatattaaagcttttcagccccgttacaatgttttattacgtgatgataaatcctatccctatattctattaacgaaagaacgtcatcctagaattacctcgcatcgaggttcaaaaaaagtacaaggtgagtattttggcccttatccccatgcaggagcggtacgtgaaactctctctttgttgcaaaaattatttcctattcggcagtgtgaaaactcggtatataacaaccgctctcgcccttgtttgcagtatcaaattgggcgttgcagtggtccttgtattgatggtttagtatctgatgaagaatatcagcaacaggtcgattttgctcggctatttttacaaggtaaagatcagcaagtgttggagcatttgatcaaaaaaatggaacaagcgagtatgcaacttaattttgagcaggcagcttatttccgtgatcaaattcaggcgattcgtgcggtaattgaaaaacaatttgtttctaacgaacgtttagatgatatggatattctggcaattgcttatcagcttggtattgcttgtgtacaagttttatttattcgtcagggaaaagtattaggtaatcgcagttattttcccaaagtgccggcaaatacggatttaagtgaattaaccgaaacgtttgtcggacagttttatttacaggggcatcaaggtcggattataccaagtaccattattgttgatcatgttttgaatgaaaaacatgaacttgaggttttattaacagaacaagctggacgtaaagtaaatattcaagataatgtgaaaggcaataaaagcaaatttttacatttggctcaaatgaatgcacaagccgcattagtaacacagcttaaacaagctaatttaatacaagagcgttatcaggcattacaagaacttttgtctttaactaccattaaacgtatggaatgttttgatatcagtcatactatgggagagcaaacaatagcttcttgcgttgtttttgatactgaaggaccgttgaaatcagattatcgtcgttttaacataagcggaattactgcaggcgatgattatgccgctatggagcaggctttgttgaaacgttatgatcgcccattagaaaatgagaaaattccagatattatttttattgatgggggaaaggggcaattaaaccgtgctttacaagtttttgcacaattaaatgtatcttgggataaaaataaaccgctcttaattggggtagcaaaaggggtagatcgtaaagcaggtttagagacgttaattattagtaaacaaaataaggaagtgaatttattgcctgatagccttgcccttcatcttattcaacatattcgtgatgaaagtcatcatcatgccattggcggtcatcgtaaaaaacgtcaacaggcttttactcaaagcggtctagaagccattgaaggtgttggagcaaaacgaagacaagctttattaaaatatttagggggcatgcaaggtgtaaaaaatgcgactttagcagaaatttcctccgttccgggcatttctgctgcgttggcggaacggatttatgaaacgctaagaagtgaataagcagtaacaaagcaaaaggggaaaatatttaatttccccttgttttatctataaaatcagcaaaatcaaagaatgatgtttccattatcatctgccggttttgttagcccgataataaattcaatgagtgcgataaaaccgggaatgaaagtccaacagaataaaagatataaaatacctaatcccgttttaccggcataaaatttatgaatacccaatccacccaagaaaaatgccagtaagcaataagcaattttatttaccggtttggctgtttgagcataggtgttttttgtttttaaaataacaggtgcttcatcagtaccgaatacatcgacttcatctctgacctgtggttcaaaatccaatgctgttcttggtacttctttgatagaaccatcaggcataccaatagaaactatgccattttcgatttttatgattttagccataacgttccctcttagtgttattagttttaattaattaaaatttttaaaagccaaggaagaaaaagctgaataagagaattttttcattggcttaaaagtgcggtttattgtactcaacctggaattagttagcaatatttccaataatgcttctcgtttcttctttaacgtctacaagttgaacatgaattatatcgccaattttgtatgttttttctcctttaatataaagtgcaatttcctcggcattgacctgaagttcttctctattgctgtgtaaggttgatgccggaataaagacggaagcaccattttccaatagaagtacacgtaatccgccacgcatgacatcttgtatttctgcttgaaatatttgtttttgttctactttatctgctaaatagcgacaatataaccaatctgcaatatctcgctcaactaaacggttttgacgacgagcctcttgtaaacgttgtaagacactatcttgagggcgttcatattgttgtgttgtgagacttgctttaattaggcgatgattaactatatccgaatatttacgaattggagatgtccatgtggcgtaaccttgcaaacctaagccaaagtgcggtgctaattccgttttaaattctgctgaggttaagaaacgacgtaaacgcaattcaagataattattttcgcttgctccaatatcatgacgcatattgcagtatccacttaaggttgctaaattttctacagaatagcgttgtttcaattctgcttgattttgttcgttggttaaatttgacagcaggaaatgatgtgcattttccaagaattttttatcgaaaccactatgagtattaaaaatcccaaaaccaattttttcattcagatattgtgccgcacaaatattcgcaataatcattgcttcttcaacaatttggtttgcaatgcgacgatattctgttttaatctcttgtactttaccattttctgccagtacaaaagagtagtccggtttttctgtaaacagtaaagcatgagttttacgccattgtgatctggctaaggtaaactcatgtaaccacgcaatttgttgttgagtaacaggatcttgtggttgccaacagcctgttttttgttctaaataatcagacactttatcataagctagtttagctttcgacattacataagcagagacaaagtatggtgtagcggtaatttcaccttgtaaatctgtggtgatataacaaaccaaagcggcacgttgaatattttcggaaagagaacacagatcgtcagatagttcacgaggtagcatcggaatattaaaccccggtaagtagttagtgaaacaacgttgtttagcatcttgttcaatttgtgaattaatatcaatataagctgtcggatcggcaatcgcaacgactaatttccaaccgacttgagcttcatttttgctaattggctcaatatataaagcatcatctatatcttttgttgtttcactatcaatagtgatgaagtgaagtgcggtgagatcttcacgttcttgttgatccaatagagggtaactttcttgcccttgcacgggataacgagattgttcatgatatgccaaagttacccaccaaggtgcaagttcgtcatcagcgtgacaaataaattcagaaatgtgtgcaaagaaaaaacgatcatcacgtaaaggatggttttttagctgtgccacaacccaatctccctcttgtaattcttctttaacggcttttgttggtgtcgctccaattagctgattaatttgggggtgatcgactacaagttgtaatttcttgtctttattgaaccgcactttggcaataaagcgagttagcatgggttcaatgagttcttccggttcagcttgttctttatcgccaatcgtttcaatcactgctttaattttgtcgccatgcataacttttttcattgccattggcggaataaaataactttttttatcacactcaaggaaaccgaaggctttgtcagaacctcttacaataccttctacatgcggtttactatcacgaatttgttgtttgagttgggaaagtaggggattattttgaaacatattcttacgctataaatgaaaacggatgttcagttgaacatccctagaaaagattaaatgtagattattctgcacctaagtcgcccatggcagtaatgctaaaaccggcatcaacatgcaatacttcacctgttatacctgaagccaattctgagcataagaatgcggctgaattgcctacatcttcaatagttacggtacgacgtagaggggctgtgttttcaaaagtggccagcattttcttgaagtttttaatgcctgatgccgctaaagtgcggattggaccggctgaaatagcattgacacgaataccgtctttacctaagtctgccgccataacacgagttgccgcttcaagagaggctttagctaaacacatcacattatagtttggaatggcacgttcagaacctaaataagtcaacgttaataagctggcgttttgatttaacattggacgggctgcttgtgccattgcaacgaaactgtatgcactaatatcatgtgcaatgcgatagccttcacgagttgccgcattgacatagtcgccgtcaagctgatcacccggagcaaaagcaatagcatgcacaaaaccatcaaacttgtcccaatgctgttttaattgtgaaaaacatgccttgatgctttcatctgttgcaacatccaaaggtaaaacaatagtagaaccaaattcttgggcaaattcttctacgcgtgcttttaatttatcgtttaaataagtgaacgctaattcagctccttcacgtttcattgccgttgcaataccataagcaatagaacggttgctcgccaaaccagtgattaaaatgcgtttacctgctaaaaatcccataataaaaccctttattcggttagttaaaaagtcggcatagtataagtcaaaatgagagaaaaaacaaaagacgcaagagtacgctgatctttaagctggattatcaatatctttaaattcaacttcaaaaccgtattcttgagctagccattcgcctaaggcctgaataccataacgctccgttgcgtgatgaccggcggcaaaaaaatgaatgccttgttctctggctgaatggatcgtttgttccgatacttcaccggtaataaaagcatctaatccttttgttgcagccaaatcaatataaccttgcccgccgccggtacaaataccgacagttcggattaagtgcggtgcattttcgccacaaaataaaggtttacgccctaatactttttcaatgcgttgagcaaattcttcaccactaaccgtttcaattaaatcaccataaacaggaatactgaaactaccgttttctaatgggcgtaaattttcaatacctaataatttcgcaagttgtgtattgttacccaactctgcgtgtgtatctaacggtagatgatacccatacatattgatgtcattttgcaacaaggttttaatgcgtttacctttcatccctcggatgcaaggattttcatttttccagaaatagccatgatgaaccaaaattgcatcagcttgttgtgcaacggcataatcaattaacgcctggcttgcggttacaccggtaataattttttgcacattggattttccttcaatttgtaaaccgttgggtgcataatcggagatattggcactattgagtttttggttgataagttgctccagttcaagattattcatattgttatccatccaattaaattttatttaatttcagttccttttaataacttacgtatccaactgcgatttgggctgagattatgtagaatatcttcgctcaaagggagtggttctgcataaatcagagaggcaagggtttcacctaataaagcggctgaagttaaccctcttgaacctaacgcaccgatgagatataaatttttccattgtgctgcatcaggaataggctgtttacgacgacgtaaattgaagatgtttcggtagtctaaacattgttgctcaaaatgaggtacattccccataatcggcacacgatcacgcactgaacaacgaacacctattctagctatattggctgatatatcaatatcctgcaaccaatccatgtttttatccgtatcggtagaagctagattttgttgaattttttgctgattttcccgttgttcttgatggctaaaatggcgatctttgttattgcgaatatgacttgcaccaaggcaatgactctgtttcattttatccgccggagttaaatagccatcgtaacaaagtacggatttaagtttcagtaaattttcactggtcggaatttggctaacctgacctcgtacgggataaagaggaagtttagctgtttgcacaaaatctgtaatttgataaccattggcgagtacaacaacttgatgattaaaggtttcattttgttcattggttaaaacccattgtaaatttcggtagtcaagtgcggtaattttttgtgaggttttgatctctaatccaagttgttgtaagtaagagaaagtattttgcacaaattgacgtggagcaagccaagctccctgcggaataaaacctcctgcacaatctaaaggaagccctattttttcacttaactgctctttatttaaattctgatacaagctttttgaccattgataagaagaaatttttgccaatttaaccgcacttttgtgatcgtaagcacaaagtgctacaccacaaaattcatgttcaaattctataccttgtttaattgcccactgcaattgttgtaaagcatagaaaaaggcatgaacataaaaacgaatgttgcgatcatcgtcatcacttaattggggataaaaagcaccttgtttgttaccggaggcattgagggcaagttgctcatcttcacaataaagagtgatttttgcccccctttttaatagtgaaagtgcggtgaaaagtgaagcgattccgcctccgataattgcaatgtcttcagaaagtaatgaggcgggctgacttaagtaccaaggggcttttgcattttgttgtggaatagcgtttttaataccacataaacattcccgctttttgccgtaaccttttcgtttttgtacttcgaatccggcagaaactaatccttttctgaccgcacttgcagcggtaaatgtggaaaatgttccttgtggcttgctgtaatagaacatctgttgatagagttcatcattccacatttgtggatttttactgggtgagaaaccatctaaaaaccaagcatcaatacgattttgcatataatcacccagttggggcaaattatcggcaatatcaccaaaccataaatccaatgttgtttcagcaaaatgaaaacgttgacaaccttgtatcgcctctaagcaataatcgcataattgttgtgataaagcagaaaattgtgggtaaaattgatgaatttgttgtagttgaactttgggaagagggtatttctcaaaggaaataaaaaataaatgtttaagtggggaatgagaatattgttgccgaaattggcgaaataaacttgttacggcaagaaaatttaaacctgtaccaaatcctgtttctgcaatgacaaaatgtttttcttgatagacaatccagcgttcccataaatgattaccttgctgaaatacgtattcgctttctgctaaaccgtcttggttggaaaaataaacgtcattaaattgttctgataccggtgttttttcttgattcaggtaaattttggcgggtgtaactgtaaacataatatagctaatttttttgttgcattcatgatttttgctataatagcgaaaattttttcactggtcgaacattcgaagaaagacttgaaatattttcattttatagtaagttggcgaccgattattttattctttaacgtaaaggaatgtttctatgagaagagccgtggttacaggttttggtattatttctagtattggtaataataaacaagaagtgttagaagctttaaaaaaagggaaatcaggtattgaagtgatgccggattttgtcaagatgggcatgcgtagtcatatagcgggaacaattaaattaaaccctgctgaattaattgaacgcaaaattttccgttttatgggagatgctgctgcttatgcttatctctcaatgaaagaggccatcgaagatgctggattgacggaagatcaagtttccaatgatcgtaccggacttgtcatcggagcgggaacaggatccggtcataaccaaatggttgcttgtgatgctgtaagaggtccaagaggcgttaaagctattggaccttatgcagtaactaaaacgatggcatctagtgtatcggcttgcttagcaacaccttataaaatccgtggcgtgaattattcgattagttctgcttgtgctacttctgcacattgtattggacatgccgtagaattaattcaattaggtaagcaggatgtggtttttgccggcggagcggaagagttatcttgggaatgtgcaactgaatttgatgcaatgggagcggtttcaactaaatacaatgaaacgcctgagaaagcttcacgtgcttatgacgctcatcgtgacggatttgtgattgccggtggcggtgcggtagtcgttgttgaagaattagaacatgctttagctcgtggagctaaaatttatgcggaaatcgttggctatggtgctacatctgatggatacgatatggttgcaccgagtggtgaaggtgcggagcgttgtatgaagcaagcattggcaacagtggatacgccagtggattatattaatgtgcatggtacgtctacacctgtcggagatgtaaaagagttaggtgcaattcgcaacgtattttctgatcaaaaacctgccatttcttctacgaagtcaatgacggggcattcactaggtgcggcgggtgctcatgaagcgatttatagcttattaatgttagaacatgattttattgcacccagcattaatattgaaactttagatgaacaggcggtaggtatgaatattgtaactgaaacaaaagagaatgcgggactcgaaaccgtgatgtcgaatagttttggttttggtggaaccaatgcctgcttggttttcaagcgttataaaaaatagagataattcttttatagtgatctatctaatgatttagacagatactgttcttttagatcttattttaaagaactattttagatattgaagtgagctgcctctaaaagttggacggaataaccaactgattagaggcagatttttatgattaaatgcaaaacaacaaactactgagtagtctttttatatttttagaatttgttttatattaaaattctctctttatctttaaataaaaatttaataaatatcaagtttaatgaatataatttttaataattgttattttgataaatttaatttaatgatattatcttaatgctttaatatggaaggttaaatcctgaaaagcaaggtactgaatacgatgttgctattaagcgaacttttatacgcatgaaacaggtcgtggcgtcttttgattttttattttattgatgtggttattatgaaaaaatttattttactcggattattactttctttttcttcatcaagcattgctgagttatctgattggattaagccgatttcggatatctcctccggagatactgcatgggtgatgatatctgcaatcttggttttatttatgactatccccggtttggcattattttatgggggaatggttcgtaaaaagaatgtgctgtcgacaatggcacaaagttttgcggtaagcggtttgatagccgttatttggttgtgttttggttatagtctttcatttacaccaaataatgcttttattggcggaatggatcgtttttttctgcaaggtttaaatgtgtttactgaacagaaaatgcttactgtttatccgggagctggaacgattccggaatctgtttttatgatttttcaaatgacctttgccattattgctggagcgatcattacaggtgcgactgtagagcgtatgaaattttcggcattattgttatttgttggattatggtcacttttgatttatgttcctaccgcacattgggtatggggaataggtggttggctagtaaatgatggggtattggattatgccggtggtaccgttattcatattaatgcaggtgtagcaggattagtcgctgcaattgtcattggtaaacgggtcggttacagacatgaagtgatgatgccgcacaatttagtattaactcttataggtacggcaatgttgcagattggttggtttgggtttaatgcgggttcggcacttgctgctgatgcaagagcgggtatggcattagcaactactcagatttcagcctcggtcggagcattaacttggatattagtcgaagtattttgtaaacacaagccgtctgcgttgggtttggcatcaggagcggtagcagggttggttggtattacgcccgctgctggttttgtatcggtacaaagtgctttattcataggtatgataacaagtgcggtctgttttgtcggtgtaatgaaactcaaatattggtttaggtatgatgatacgctcgatgcgtttggtattcacggtttaggcgggattgttggagcggtgttgacaggcatattcgtatctcctgatatttcagctaccgaaaccacactttggacacaaattgagagtgtactaattactatcatttttagtgcatcaggtagttttgttttattaaaaataattgacaaaaccgtagggttacgagtggagcgagatgaagaacgtcaaggtttggatttaagttgccatggtgaaagaatagaatagttaaaaaatgacagcactttacgctttataaagtgcggtcagattatagtagctatataatttgaagatgaaattcgaacacctattatttggcgttaattaaataatttttccctccagtatccaaattcttttaacaattgtgagtttatgttcaaagaaattgcttgtatttgtacttaaatcgtgaagttagtcgctgatggttgtagaaaaaataaaagttacattctaaaagaagatccaaaatttaaacacgcaatagatagttttgaatggacagcttagcctgtgggtaggggcttgccctcgttctctgttttttgttatcaacctattttcaggtaaatacagagaacccttctcgactagtttggatttaccgagtaatcaataagggaatatgtctgaaaaaatggttcatttcttaattgttagcatactattatcaagctgcatgagtactgctataaaattttaggataatttaggataataatgggggaactctctcaaaaagaagccaaaatttttgatcaatgtcaagagggggtaatcaattaaaaagtaataacagatttaaccattaacttttaatttacggagatatatgatgaacagcgtgaacaattcaattttttaacgaactaacccattcgtcaaatgtaatatcactcaaattaataattttgaaaaagatttttcaatcaaaagccctgaagattatagaaattatttatgctatttaataatagcggagctagtgttcatcatatgtatggattgcataattatgagacatgtagattttgaatggaaaaaggcatgttggagcatgaacagggaactttagatcggttattataatttggagcgggaaacgaggctcgaactcgcgaccccgaccttggcaaggtcgtgctctaccaactgagctattcccgcttattcctgaagaacggagcgtattatacaaatattttactaagaagcaaggttaaaatttaaaaaaacgcaaccttgcttgattattggttgaattaattatttggttgttaagttaataaaggtcttcctataatgagctaattcagcaatggattcacgaatatcatctaacgccaaatgtgtgttctttttttcaaagctatttagaatttcaggtttccatcttgatgcgagttcttttagtgtgcttacatctaaatgacgatagtgaaagtattcagctaattcaggcatgtagttgattaaaaaacgtttgtcttgagctacactgtttccacaaataggagaaacacctttaggaacccatttttttagaaaatccaaggtttgtaattctgcagcccgttctgttaatttgctgttttttacccgttcgattaagccgttagatgtatgagttttcacgcaccattcattcatgttattgagaagttcgtttgattgatgaatggctaaaacaggaccttcagctaaaatattgagatctttatctgttacaattgttgcgatttcaataatccgttctttatcaggatctaagcctgtcatttccaagtcaatccaaataagattttgtttatctaattgcataataagagtatcctatacaaaatttcttatattctaactgaaaaatgaccgcactttaaggatttctctttgagcaaacgtaaattaacccaaaatcaacaacgtcgaattcaatctaataatgcaaaaacattacatcgtcatcaacatcggcacaaatcagatattgattggcaagatgatatgcttggtgattttcaagatggaacggttgtgacaagatatgctgttcatgctgatgtagaaaatgaacaaggtgaaattgttcgttgtaatttacgccgtacattgaaaagtgtcgttgtgggcgatcgtgttgtttggcgtaaaggaaagacacaactacaaggtgtaagaggggtcattgaagcggttcaaccacgacataatcagattgtacgcccggattattatgatggtttaaagccgattgcggctaatattgatcgtattattattgtttcagcggtattaccaaatttatctctcaatattattgatcgttatttagttgtttgtgaaagctcgaatattccagccgttattgttgtaaataaagcagatttattgagtagtgaagctcgaatagaagttggcttacaactcgaaatttatcagaaaataggttatgaaacgttattaatctctgccaagagcggtgaaaatatggataagctaaccgcacttttgtctgagggaacgtctatttttgttgggcaatcaggtgtgggtaaatcaagtttaattaattatattttgcctgaagtgaatgcacaaactggtaagctcagtcaagtatctggtctaggtcagcataccacaacatcttctcgcctatatcacttatcacaaggaggaaatttgatagattctcccggtattagagagtttggtttgtggcatttagagcgagatcaaatcacgaacggttaccgagaatttcagtattttttgggaacttgtaagtttcgagactgtaaacatttgcatgatccggggtgtgctattcagcttgcagtgaaagaaggaaaaatcgatcctttacgttttgaaaattatcatagactaattacaagtttgtccgaaactaaatctcaacggcattttatatcggcgaattaagttaaagaagatattttgtatacttaataaacaacttggggctttttttgtgatgtagttcaaattttaatgtggtttaccttgattattctgatttgaaacttgatactatgcgtccgatttatttttttatttaaaataaatatgaactgacactaacgaattgtttttgaagcgttaggatactacatgtagaatgatttaaattaagaggatacagttatgtactcaaaagatgttgaaattactgcaccaaatggtttacacactcgtccagctgcacagtttgtaaaagaagccaaagcgttcgtttctgatattacagtaacttcagcgggcaaaagtgctagtgcaaagagtctatttaagttacaaaccttgggattgactcaaggtacagttattacgatttctgctgatggtgaagatgaacaaaaagcggttgaacacttagttgcattaattcctactctagaataatcaatatatttattagccataacttaatgttttcataaataataagtttatggctattgtgttatttagcgtattgtaatttaaaattattttggaaggttaatatgatttcaggtattacagcatcaccaggtattgtatttggtaaggcactggtgcttaaagaagaaaagattgttcttgatacgcaaaaaataaaagatgagcaaatagacattgaagttgctcgtttttatagcgggcgtgcggcagctatagagcaattgattgcgattaaagatcgtgctttagtctctttaggtgaggaaaaagctgcaatttttgaaggacatttaatgatccttgaagatgaagaactggaagaagaaattttagattacttacgttcaaataaggtcaatgcaggcgttgctgcaagtaagattattgatcaacaagttgctatgttgtctgaaattgacgatgaatacctacaagagcgtgccggagacattcgtgatattggtaatcgtttgattaaaaatattttaggtatgaaaatcgttgatttaggggatattaatgaagaggctattttggttgcttatgatttaaccccttctgaaacagcacaattaaatttggataaagtattaggcttcattacagacattggtgggcgaacatcacatacttctattatggctcgttctcttgaattgccagctattgtaggaaccaatgatatcacttcaaaagtcaataccggtgattatctcgttcttgatgcggttaataatgcgatttatgttaatccgacacaagaagaaattgagcgtttaaaagctttagaacgacaattagctgaagaaaaagcggaattagctaaattgaaagatttaccagcattgactttagacggacatcaagtagatgtggtagctaatattggcactattcgtgattgtgagggagctgatcgtaatggtgctgaaggtgttggattatatcggacagaattcttatttatggatcgtgatcagttgccaacagaagaagaacaatttattgcttataaagaagttgttgaagcaatgaatggtcgtttagttgtgttacgtacaatggatattggtggagataaagatttaccgtatttgaatttacctaaagaaatgaatcctttcttaggttggcgtgcgattcgaattggtatggatcgtcgtgaaattttacatgctcaattacgtgcagtattgcgtgcgtcagcttttggtaaattagctgttatgttcccgatgattatttctgttgaagaaattcgagaattgaaatctgtgattgaaagtttgaaacaggaattacgtgatgagggtaaggcttttgatgagaatcttcaagttggggtaatggttgaaacaccggcggcagcaataaatgcaaaatttttagcaaaagaagtcgatttttttagtatcgggacgaatgatttaacccaatatactttagcggttgatcgtgggaatgaattaatttcacatttatacaatccgatgacaccggctgtattaaacttaattaagcacgtgatagatgcatctcatgaggaaggtaaatggactggaatgtgcggtgagttagcaggcgatgaaaatgccacattgttattgttaggtatgggattagatgaatttagtatgagtgcaatttcgatacctcgtattaaaaaattgattcgcaatgtgaattatcaggatgctaaattacttgctgagcaagcattacagcaaccaactgcggcaggtattttgagcttagttaatgattttttagtggaaaaagcacttaattaatatcatttgataaaaaattacgctagaatagtgcaattattcatgagtaggagaaagtttaaatggctttttttgataaattatttggttcaaaggaaagcaaatctattgatgttgaaatttatgcacctatatcaggtacaattgtaaatattgaggatgtaccggatgtggttttctctgagaaaatagtaggtgatggcatagcaattcgtcctacggggaataagattgttgcacctgtagatggagtaatcggtagaatatttgaaactaaccatgcattttcaatagagtccaaagatggcgttgagttatttgttcactttggtattgatacagtagaattgaaaggtgaaggttttactcgtattgttcaggaaggtcaacaagtaaaacgtggtgaaacaattattgaatttgatttggcttcattggaagcaaaggcaaaatcagtattaactccgctggtaatttcaaatatggatgaaattaatagtatggataaaatgtctggcgaggtcgtggctggcgagtcagttgtactcttgttgaaaaaataatgaatagtgttatttaaaacggattggtagtggctaatccgtttttttatatcaataaatttttaaggaagaacagcatgtgttttttctattttcatataaaaactactatctttatttcaaaaaatctaataacatttacgaaatttgttaagatttgtggcgtaaactagatttgattagtttcgttgtgagttttgctaacattatcagaattttagttatcaatccgttgtttaatttagtgttataaattaaacgtaccttttaacttaacacaataaggaaaagactatgtcagatatattgaaaaatgacgtagatccggtcgaaaccaatgattggttattagcgatcgattcagtaattcgtgaagaaggtattgagcgtgctcaatatattatagaacaattgatgcaacatgcccgtgcaaattctgtgtcattaccaacgggtgtaagcacagattacattaacacaattcctccatcagaagagcctaattaccctggtaatttagacttggagcgtcgtattcgtagtgcaattcgttggaattcgataatgatggtattgcgtgcttcgaaaaaagatctggatttaggtggacatatgtcttctttccaatcttcagcaactatttatgaagtttgttttaaccatttctttaaagctcgtacagaaaaaaatggtggtgatttagtttttttccaaggtcatatttctccgggaatttatgcccgtgcattcttagaaggtcgtgtaacagaagagcaattagataatttccgtcaagaagttgaaggcaaagggttaccttcttatccacaccctaaattaatgcctgaattctggcaatttccaactgtatcaatgggacttggaccattgaatgcaatctatcaggcacgtttcttaaaatatttacataatcgtggcttgaaagacacttcagagcaaactgtttatgcgtttttgggcgatggtgagatggatgaagtagaatctcgtggtgcaattgcgtttgctgctcgtgagaaattagataacttagtttttgttatcaactgtaacttacaacgtttagacggtccggtaaccggtaacggtaaaatcattcaagaacttgaagctcaattcaatggttctggttgggaagttattaaagttatttggggacgccgttgggatcgtttattacaacgtgatacatcaggtaaattattacaattaatgatggaagttgttgatggcgattatcaaactttcaaatctaaagatggtgcttatgttcgtaaacacttctttggtcgttatcctgaaacagaagcattagttgcggaaatgacagacgatgaaatttttgcacttaatcgtggtggacatgatccattaaaagtatttgcagcatttaataaagcaaaacaagttaaagataaaccggttgtattgttggttaaaacgatcaaaggttatggcatgggagaagcagccgaaggtcgtaatatagctcatcaagtgaaaaaaatggatatgtcaggcgttaagcatgtacgagatcgtttcaatgttccggtatctgatgcagaaattgataacttaccttatgttaaatttgcagaaggaacagaagaatataaatatcttcatgaacgtcgtcaagcattgaacggttatttaccgactcgtttacctcgctttacacaacaaatggatgttcctgcattagaagaatttgcacaattatttgaagaacaaagtcgtcctatttccactacaatggcatttgttcgttcattgaatgtattactgaaaaataaatctgtaggtaaacatattgttccgattattgctgatgaagcccgcacttttggtatggaaggtttgttccgtcaaatcggtatttataacccacatggacaaaattatactccgcaagatcgtgaacaggtatcttactatcgtgaagcaattgatggacaagtattgcaagaaggtatcaatgaacaaggtgcaacagcatcttggttggctgcagcaacgtcatattcaacaaatgatatgccaatgattccattctttgtgtattattctatttttggtttccaacgtgtaggtgatttaatgtggttagcaggcgatcaacgtgctcgtgggttcatgattggtggtacttcgggacgtacaaccttaaatggtgagggattacaacatgaagatggtcatagccatattcaatcttctgttgttccaaattgtatttcttatgatccggcttttgcttacgaagttgctgttattatacaagatggcgtgcgtcgtatgtatgggcctgagcaagaagatgtgtattactatatcaccacactgaatgaaacttatgatcaacctgcaatgcctaaaggtgcagaagaaggtattcgtaaaggtatctataaatttgaaacagtaactggtcaaggcaaaggtaaggttcagttattaggttcagggtcaattttacgtcatgttcgtgaagcggctaaattacttgctgacgatttcggcgttacatctgatgtgtacagtgttacttcatttactgaacttgctcgtgatggtgcgaatgcggatcgttggaacttattacatccaaaagcagaagctaaagtaccttatattgctcaagtaatgaatgatgctccggcaattgcttcaacagattatgttaaactatttgcagaacaggttcgtccatatatacctgcacaaagttatcgtgtattaggtactgatggttttggtcgttcagatagtcgtgaaaatttacgtaaacatttcgaagtaaatgcacattatgttgttattgctgcgttaaccgagttggcacagcagggtactatcagcaaagatgtagttgctcaagcaattagtaaatatggtattgatgcagataaaatcaatcctttatatgcataatcaatatttgaactgagcggatataatccgctcataagaaaaggataagataaaatggctaaagaaattcaaattccagatattggtggagatgaagttactgttactgaagttatggttaaagctggagatactattatagttgatcaatctgtgattaacgttgaaggcgataaggcatcaatggaagttccatcaccggaagcgggtgtcattaaggaagtattagtaaaagtaggcgacaaagtttctactggaactcctatgtttgtattagagaatgcagaattagcatctaccgagacagcatctgaaagtatgcaaaccgaaaaaacacaaagtgcggtagcgtctatcattgaaatttatgtacctgacattggtggtgatgaagtcaatgtaactgatattatggtttctgtaggtgagacagttgcagaagagcagtctattttaaatgttgagggtgataaagcctcaatggaagtgcctgcccctactgccggtatagtaaaagaaattttaatcaaagtgggagataaagtgtcgaccggttctcttgtgatgaaatttgaagttgcaggtgttgtatttgtagccgaaacagctcaagtttcttcttcagctgaagtaacaggtgaaagtgcggtgcaagatgtacacgttcctgatatcggtggtgatgaagtcaatgtgacagaaattatggttgcagtgggcgatagtgttacagaggaacaatctttaattactgttgaaggtgataaagcttcaatggaagtgcctgctccttttgctggtgtagtgaaagaaattttggtgaaatcaggggataaagtttcaactggttcattaattatgcgttttgaagtgcaaggaaaagcccctattccagaagcatcatcggcggtgacagaggctaaagtggctccacctccagctgcacaagaaaatcaaatgacgccagtgtctcaagctgatgtgactgcaagtgcggtgtttgctcatgcaactccggttgttcgtcgtttagctagagagttcggcgtgaacttagacaaggtaaaaggaacgggtcgtaaaggtcgcatcttaaaagaagatgttcaggcttatgtaaaagcggcaattaaagcggttgaaagtggcaatgtttctcctacatcagcaggtaatggtgctgtcaatggagcaggactaggcttgttaccttggccgaaagtcgacttcagtaaatttggtgatattgagcaagttgagttgggtcgtattcagaaaatctccggtgcaaatttacatcgcaactgggtaatgattcctcatgttacgcaatgggataaagcagacattacggaactggaaaaattccgcaaagaacaaaatgtgttggcggaaaaacaaaaacttgatgtaaaaattacgccattagtatttattatgaaggccgttgctaaagcgttagagaattacccacgctttaatagttcattatcagaagatgctcaaagcctgattctgaaaaaatacattaatattggagtggcggttgatacacctaacggcttggttgtacctgtgtttaaagatgtgaataaaaaaggcattattgaattatctcgtgaattagcggaaatttctaagaaggctcgagctggtaaattaaccgcatcagatatgcaaggtggttgttttactatttcaagtctaggaggaattggcggtacacactttacgccaattgtaaatgctccggaagtcgcaattttgggcgtatctaaatctgaaatgacaccggtatggaatggcaaagattttactcctcgcttaatgcttccgttatctttgtcttatgatcatcgtgtaattgacggtgctgatggagcaagatttattactttcattaatagtgtattaagcgatcttcgtcgtttagttatgtaaatactacgcctctaaatcttattagggggcgttaaaactgttaaagtgcggttgaaaaccgccaacttttaacgaggtaaaaaatgaataaagagattaaaacacaagttgtcgtcttgggagcaggtccggctggttactcagcagctttccgttgtgcagatttaggcttagaaactgttattgtagagcgattttcgacgcttggtggagtatgtttaaatgtaggttgtattccgtctaaagcgttattgcatgtagctaaagtgattgaagaagctaagtccttatccgttcatggtattgtttttggtgaaccaacaacggatattgataaaattcgtggttggaaagaaaaagtaattaatcaattgactagcggtttagccggtatggctaaacagcgtaaagtacaggtagttaatggttatggtaaattctcaggaccaaatgcaattattgtggctggtgatgaaggtgaaacgaaaattacttttgataatgcaattattgctgccggctctcgccctattcagttaccatttattccacatgaagatcctcgtatttgggattctactgatgcgttaaagttaaaagaagtacctgaaaatctcttaattatggggggcggtatcatcggtcttgaaatgggaaccgtttatcatgctttaggttctaaaattgatgtggttgaaatgtttgatcaagttatccctgcagcggataaagatatggttcaaatttatactaaacgcattgaaaaaaaattcaatttattactggaaactaaagtaactgctgttgaagcaaaagaagacggtatttatgtatcaatggaaggtaaggctgcaactgaaactcgtcgttatgatgcagtattagttgcaattggtcgtgtaccaaatggtaaattaattgatgcaggtattgctggcgtcgaagttgatgatcgtggctttattcgcactgacaaacaaatgcgtactaatgtacctcatatctttgctattggtgatgttgttggtcagccaatgctagcacataaaggcgtacatgaaggtcatgtagctgcagaagtaattgcaggacaaaaacattattttgatccgaaagttattccatctattgcttataccgaaccggaagtagcttgggtggggaaaactgaaaaagaatgtaaagctgaagggattaattacgaagttgctaagttcccttgggcagcgtctggacgtgcaattgcatccgactgtgctgatggtatgacgaaattgattttcgataaagatacacatcgtgttattgggggagcaattgtcggtactaacggtggtgaattgctaggtgaaattggcttggcaattgaaatggggtgtgatgctgaagatttagcactaacaatccatgctcatccaactttacatgaatctgttgggctagccgctgaagtttttgaaggctctatcacagatttacctaacccaaaagcgaagaagaaaaaataataatctagctcgctgagacaataaggcgatcttttatgagatcgccttatttttttgcaaaaaagtgcggtaaaaaatacggcactttttaggcggcaaattttatttgattttcttttggttttatttgatggattgtgttggttacagtaccaataataggcaaagtttgccaattagatgttcttattgaatgtactttattatctagtgggaaaaaaataaattcattattttcatacatcatgaattcataaatttgaaattggttattaagatctaaaacgacaagatcattcattgaaaggtaattttgtttttctactataagaatatcacctggctcaatattccaagcgagcagattaggattgttaacttgaataaaacaagtttgttgtgggtgtttaatacagtaaagattgagatctagttttttgtgtgaacttctattacgttcctcaatatcaatgaagaatggcataggttggtaagaaagtgtagtgtttatattgctgatattctgatttgcgtaacccatctttttctccaatctaagtatgttatatgttaactgattatttatacaggtatatattactgtttttatatacatatggtcaatagaataatagaaatttttagaaatttgcagattaataaatgtattttattttataaaaattcaaaaaatgtttattttaatattttctttataatcaatttacgttatctttactaaaccttggtggatctatagatctgtatttttaactcaaaaaacacaacatttattattatgaataagtcatatttatactccttcttttttcatggaagtttggtcaagcgaatttctgttggtcttttattgggattgctgttagcattaatcgctccatcattgcaaggtgtattaggttttaatcttgcagaaaaagccggttttttaggaaaaatatttgtgcgttcattgcgtgcagttgctccaattttagtttttttattggttatttctgcaattgctaataagcaattaggcacaaaaagcaatatgaaatctattgttgtcttatatttgctaggaactttcttagctgcattgacatcagtattatttagttttgcattgccgacagaaattgctttaaaaacgcaagaaggctctctttctccgccaaacgaagtatctgaagttttaagtaccttagtactgaacgtggtagataatccaattaatgctttatttaatgcaaactttattggtatcttattttgggcaataggtttggggatagccttacgctatgcgtcagatacgactaaaaatgtcatgaatgatttttcagaggctgtatctagaattgttcattttattattagttttgcacctatcggtgtttttggtttggtggctgaaactttaactgataaaggtttaggtgcattgcttgattatatgcaattactagttgttttaattgggtctatgctatttactgcatttgttattaatccaattttagttttttggaaaattcgtcgtaatccatatcccctagtatggacttgtgtacgagaaagtggattaacggcattccttacacgtagttctgcagcaaacattcctgtaaatatggaattgtcaaaacgcttaaaattagatgaggaaacttattcagtttcaataccgttaggtgctaatatcaatatggcaggtgcggcgattactattacggtattaacattagctgctgtacataccttaggtattgaggtctctttccctacggctgtattgttaagtgtagtggctagtatttgtgcttgtggtgcttctggtgttgctggcggatcattattattgattccattagcttgtagtttatttggtattcctaatgatattgcagcacaagtaatcggcgtcggtttcgtcattggcgtattacaagattcaacggaaactgcattaaactcttcaacggatgttatttttacagctgcggtatgctggagtgaagaaaataaaaattcatagagtttatctaatgtgaaatatagcgggtatgggtacatatccgctttttcattatacttgatagccttctgcatgaagtgataaagtagaaaaaatttcatttacgatgagaatgctttagcatcactgtactttttgctttgaaatggagatatccctctcataaaaacactatagttttcataagaataagttattttcaaaatatactaataatccatatggttattaatttttacaaaaactttctgttcaataatttaaaaaagaggaatataataggatacactagtttaatagtcaggagagaaatatgtatatcagtcggaatatggaacaatggaatgaatttcttgatttaatgagaaaagcatttgaacaaggcaaagaacaagaactacttactttgctacttactgctgatgagcgagatgcagttgcactacgcgttcaaattgtatcccaattactggataaatctttggcacaacgagagatacaacaaattttgaatacaagtgcggcaacaattaccagaggttcaaatatgattaaaattatgcctcctgaatttatggactgggttaaacagcaactaaaccataacaataaaaacgaattaggtggtgactaataaaagggtagtaagagtgagaccttaagtcatttttgtttactattttcctatacaaatgcacttctaaacagaaaacagtctttactataaaaaatttacgtcaaaaaaatctgacagtttcatacttaaagagaacactgtcagatttaatttactgtatagtatgatgattatgcgttattaccagtgattttagccacttccgctgcaaaatcttcttcaactttttcaataccttcaccaacttctaaacgaataaagtttgttactgaagtattaactgattttaagtaatcaccgacagaaactgaaggatccataacgaatgcttgaccggttaaagacacttcaccagtgaatttcttcatacgaccttcaaccattttttcagcgatttcttttggtttgcctgagttgattgcaatatcaatttgaatttgacgctcatgttctacaacttcagcggaaacatcttctggatttacgaattcaggtttagaagctgcaacgtgcattgctacttttcttaattcttcttctgaaccggatcccgctactaacacaccaatttttgcaccatgtaagtattgagcaattacatcaccctctaaatactgaacacgacgaatcgtcatattttcaccaattttagcaactaacgcagcacgtttatcttcaaaatgagttgctaaggtatcaatcgttgttcctttgtttgccaaagcgtaatcagcaacttcatcagctaaacctaagaagccggtatcttttgctacaaagtctgtttcacagttcagttcaactagaacaccaaaaccggaaccaatgcgtacacgaataacaccttcagcagctatacgacctgctttttttgcagcttttgcctgtcccgatttacgcatattgtcgatagccagctcaatatcaccatttgcttcaactaatgcttttttacactccatcatacctgcaccggtacgttcacgaagttctttaactaatgctgctgtaatttcagccatcttaaattcctctatccatttgattaaatagtatcggttttagaccgcactttatcgatataaaaagcagggaactaaaagccccctgcgtttaattaataagggcttacgcctttactgaattattctgctgctgcaaaaacttcttcagttaccgtttcttgattacgaccttcttttactgctgtggtagctgcagaaagatataattgaattgcacgtgacgcatcatcgttacctggaataacaaaatctacgccatctgggcttgagttagtatcaacaattgcaaatacagggattcctagattatttgcttctttgattgcgatatgttcatgatctgcaccgatcacaaaaattgcatcaggaagaccgcccatatctttgataccgccaagacttaattcaagtttttccatctcacgagtacgtactaacgcttcttttttcgttaatttatcaaaagtaccatcttgagattgggtttctaaatcttttaaacgtttgattgattgacgcactgttttccagtttgtcaacatcccgcctaaccaacggtgatttacataatattgttgacagtctaatgctgctgctttaacagcttcagaagctgcacgttttgtaccaacaaataaaattctgccgttattactcgcaatacgagttaattcaactaacgcttcattgaacattgggacagttttttctaagttgatgatgtgaacaccattacgaggtccgaaaatgaacggtttcatttttgggttccagtaacgagtttggtgaccgaagtgaacgccagcttgcagcatatcacgcattgaaacttgtgccataagataattttccttttgtttggggtttagcctccacatatcaagcaaatcgaccgtttggcaccccgatttacttctcatgatacgtgtgtgatttcgtaagttaattgttaaattgacaactcaaaataacgtcgcactttataccacaaagtgcggttaaaaactagaagaaactcttaaattttgcaaaaaaataatgcctgataacttcaggcactatttttgcaattcgaagaaatgtaaacctgcttttactcttcattaatgaattttgtattaatttcaatactggctttttctcttaaggcttgaataagcaaattgcttaaactaaattgcttaatttttgctatttgaacgccaaataattgtttttgctcaggcgttaattggctattttctacgttcattaactcaacaaaaacaatatctccaaacatatttttcgctacagatatggttgttttgcccgggtcaggttttttcattgagaatatcactttgcctaaaacaggatctttattatctgcatctctataaacccacgtttctttttctgaaaaatgaatataagacggtaatttgaaatcagttattgtattcatctctgcaacgattttctctgccatattaaacaacgtagtttcggctttgtgacgttttaaataagtttcaatatctgctgttgcctcagctagtgtacgaataccctcaggtttataatcaactacacgcagaagcacggaatgttgatcgccaacattgattgcctctgagtttataccgccttgcataagatcagaattaaaaatggcggtagcaatatgactataatttaattctggtggtaaatcttgacgagaaaaataatctgtttctttgatttcaagccccgctactttagctgcttcttctaatgattgcggattttcaaacgccttttcattcatttgtttttctaatgaataaaaagcatttgttactaaatcattacgcaatttagttgcaatttcctctttaacatcatttaattcacgggttttcatatccaatactttaatgatatggtacgcattatccactttcacaggctggctatactcaccaacatttaataacgtcaccgcactttcaaaagcaagaggcatcattccattcacaacccaatccaaatctccacctttttgggctgataatgtgtccattgaatataattttgctaaagcagaaaaatcttcgccattttgtaaattagcataaactgattgtgcttcttgttcagtcggtaattgaatatgagctaaatgttttgttatatattgagctttattatcttgataatattgtgcaatttctatatcggagatttttactttctgatccgcaatcgcacgagttaagtctagatattgtactttaactctttcaggtacagcaaagttagctttgttagcttgataatattgttcgatttcttgctccgttacagtttgtttttgcatttcgtcatttaaagatagaacagctaaacgaacatcacgacgttggaaaaaattctttgctaattcattgagttgtataggaacctgaaaatcactatttgcaataccttgctgtaattgctctaataccaagccttcacgcacatatgcagcataagtatcagaactaataccacttgaagctaatatctgctgataaattttattgtcaaatttgccctcattttgaaacataggtgagttcacaatagctaaacttacttgcttatcgctaattcctaacttaagttcttgtgcatattgacgtaataattcttgattgattaaacgatcgagaacttcatgtcttagatgtttagctgccgaatctgcaacttcagcaaatttagctcctaaattttcacttaaacgttgatattcattgttatattgctgtagaaaaacttgttgagaaatttcttcgccatttacttttgctacagatgtatctgtccgtataaacatataacctgctacgccactgagtacaaaagaaaccccgattaagccaaaaataattttagaaactataccgctagaggcattgttcaatttttccattaacattgaagaaatcctataaatgttagattaaaaagaaatgtgtaaaattataatcgaaagtagctcaattcgcacgattaaaataataattcatcaacaaaacactttattttatagattgaattaattctgtggcagtgcataagatacggtatcttagaattatgataaaaatatttaactgatctaaagtagtttaaaagtgcggtgctaattcatgacttttacgagtcatacataaaaaaagagtggatttcccactcttttattaaaaaccaaagtcttatctttttatcattcaaccactaaagcacggcaagtactcgtaccatttgacgttaagtggtctccttgagttaataaaaccaaatcaccggaaactaaataacctttatcttttagcgattgtatggctgcttttaatccttcaagcgtacgactatcctgatcaaaatgaattggaataacaccacgatacaatgcacataaatttaatgtactttcatttcgagaaagggcaaaaattggtagtccggaactaatgcgagacatcaattttgcagtatgaccactacttgtcattgcgatgatggctgcaacacctttcatatggttggctgcaaacatcgtagacatcgcaatagtttcttcaatcgtatcaaattctttatctaagcgatgccgagaaatatttacactaggcattttttcagcacctaaacaaactttagccattgctgaaacagtttctgaagggtattgacctgctgctgtttccgcagaaagcatgacagcatcagtgccatctaatacagcattggcaacatccatcacctcggcacgagttggcataggattgctaatcatagattccatcatttgtgttgcggtaatcactacacgatttagctgacgtgaacgacgaattaattttttctgtattccgactaattccggatcaccaatttcaacacccaaatcaccacgagcaaccataattacatcagaagctaaaataatatcgtccattgcctcatcgtcaataacagtctccgctctttcaactttagccacaattttggcttttaaaccagcttgttgagctaattcacgagcataatttaaatcagcactggaacgagggaaagaaacagcaagataatcaacaccaatacgtgcagctaaaataatgtcttctttgtctttttctgtcagtgcgttagcagataacccaccacctaatttattgatacctttattatttgataatggaccgccaacaattacttctgtaaatactttagtattgtctgtcgataatacttttaactgaacacgtccgtcatccaataataaaatatcgcccggaacaacatcttgcggtaatgttttataatccagtcctacggcttcttgattaccttcacctttgggtaaatcagcatctaaagtaaaattatcaccaatatttaagaaaattttaccctctttaaaagtagatacccgaatttttggaccttgtagatctcctaaaattgcaacagttttacctaattttttagcaatttcacgaactttttcagcacgagcaagatgatcttctggtgtaccatgagaaaaattcatacgaacaacatttgcaccggctacaataattttttctaaattattacctcgatctgtggatggtcccagtgtacatactatttttgttcttcttagtcttctagacattcgttactccgtttaattattttgaataatataagattattaatttagtaaaacccgctcattatatgcttaaaataaaattagatcgagatcacattttggaaaattcttattatagctggataatggaaatgaatattcagattttttctctttttcttttcatgactgttgataaagtaagacttttatatattctttaaaaactttgttaatcatcaaccgcaccaacacacaaaaaaagcagtgattgctcactgctttttcacggtcattgaatgaaacctaccaggtccagccaacccctacaccaccgccgaaatcaccggcagagtttctgctaccatgtaatttcagcattattttaccattatcgctcaaacgcgaataacctaatgccaccgcattgtttcctttataggtacccgcagataaagcaaggctcgatttgcccggcatcgttactgtaggcaatgcggcagcagcatgtgctccagcaaccccggctctcaagtctttattgaatatctcaattttattgtcgagatggttgaatttttggtcagtatgtgtctgcaaggcatcgacatatcctttgttgaccacggccttcggtgaagagttcggcattaaatccggcactctgatttctcctttctccccgtcaatctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatccgttgccgtcaagacgggatttattcccctctgcggtttctttggtttcaaaagangtcatatttttcaacttatcggacagtttgacttccatcccgctgtcagaagcagtcactttratattgccsgccgcsgtggtyrcrctgttaaaykygccctcgcctttgatggtcaawttctcgcctaaatttttatggacaggcacgccgtcattgccctcaaaatttaagcccgcttgtcctaaagcctgcaagtcttgcaagtttgccccacggtgaacatcgannnnnnnnnnnnnnnnnnnnnnnnnnnnnnnnnnnnnnnnnnnnnnnnnnnnnnnnnnnnnnnnnnnnnnnnnnnnnnnttttaatatgccttgtgccgattcaacctcttttttcgccttatccaatttcgagttaatgtcggctaatgttgatttttcgccctcgatcttagctttggctttctctttcgccgctttttcctccggtgtagtttccggcatgaaagacaatgcggtttcaagagcgtcaatggcgtcctgtttcgcctcttttgctgtttgtagcgtcaacatatcgtctacttttttcgccaccgcctgtgcttcggttttcactgcttcgcctgcctttttcacgttttcggcatgctctttygctttgtcrgcatcaatacccaamccgcttgccacgttgcccagcactacagrkttatcggtttyaccaycggtattgacyagmgaaagttgcgtatttaccgcacttttatccgctttcggtgtaccgttatyctcaacatcttcggctttatagtayttaccatcattrgctttgacyarwckwtyrccktkwtkatckgtaaayaccacmgytccmrcytcrccrtykcgyaaagcgttngctttrtcrttrgcrtttttgccrttyaaaccgtctttrccrgttaagcctttmgycgccatcgattttttgccgtctgatgttttttcaagacctgacaatccatctttaccgtccgcaaagaccattttcttcgctttcggatcggtttcagaagaacttgggtcatcaatgaatttcgcccctgtcgctttgacaagctgtccaccgttgaccgcatctttggagtcagtcgataacttgccatcagcaatattggttacaaccatggcttttggctcagctttgatcaccacagcggcttgtttgtccgctataggcgtaacctgacctgttccatctttggtgtatttgccatcggcatacttcgcatcctttcagtcggttggcttatagaatttaccatcttcacctttaaccactttttcattatctagataataatcaaatggtctatttgaattggctgatgaaagtttttgatcaagttttttaacttccgtatccacatagtttttattggcgacacttgaaccatcggcaccatcagctaaatcagcaagaccggtaatcgcacctatatatttaccatcagcacctttaccaaaagatagggtcgctttctctttctctttacctttaccgtctttatctttggtaactttcaggctgattgcttcagttgagccatctttacctttcacggttaagccgtctttaccataaacagtgtgggttttatcgccattagttgcgtctttatcacccacggttaaacctttatcgttcaaggtcgcaatagtcggattaccatctttacctttcaatgtaattgcattgccgttgatattaacagtattacctttgtcgtctttaaactcggcagacttcaagccttttaattcctcattgagtgaaatttctagcttgctctgagcactatccgccttcaccgcaatattgccgtcggtgcctttgaatgtagtaactttagctttatctaagcctttgcccacaatctccagtttttcgccaaggtttttatgcacaatgctgtcgctgtcattgccggcaaaatccagtcctgcttgtgcgacagcttttaagtcgacaacattcacggctttatgcgatgaatctttatcaagctcgcctgacacgagttttttcaccaactcacgttgtttaccttgtgtggctgaagcaatgccactgtctttaatatcatcaatacccaaaccggatttgaggttatcaatcgcaacaggtgcaactgttttgcctgcttcaggtttaccgcctagagtgatggatgtttttgtgtcatcatcatatttcaccgccactttctctgcttcggagtgttgtgcggtgactttccctacaatagccttggcaaccgcagacaagtcttgaacattgacagcattgttggcgatcttgctgccattggtattgtccttatcaggtgttccagcgagtacgttttcaatgatactgtcatcattggtactaccgtcttttaagcccagcccactcgcaagtcctttaatttgtttggtatttaaggttaatccggttctgtcaaagacaaaggttccaccattggattcaatgacaacattagtttttggttttgtaccattcgctccttgtttgttaaattcaatgctagaagcgatttttttacctttgccagctccgatttctcgacctccaatagacttaatgcctttcaaatcagaattgagagcaatttctagcgtagaggcatttttcttcgctgtggtagtgatattttgatgtgttttagccgaacctgaacccaccttacctttaattttcaagctgtcattaacggtaaatttagagcctttattcccctcaacttcaaattttgttgcatagttcattaatttctctgccaccgctttggaggtaaccgctctttcatcgtgttcggaaaccttatccgctttatttagggttaaagttaacttagccccgtttccgtcttttgtaacacttgttttgatatccttttctttcatgcctctatcgtctttcttggcttccgaactatcgatcgtcaacaacttgtctaagttgaccagttgttctgtttgacctgagtcatttcctttgaatttaagccctctttcgtccacatattttttattggcggcgtcatagttgtccgttggatcggcaacaaacacaattttccgcttatgtcgcattgacccgactgacaatgcattggacttcgccagcgaacctgtccccaatacaatggcattatgtatctcatcatctgccgtgatattcgagcctaagatgatgttttcgtttccttcaacttcatttcttgaaccgattgaaatattctgtttaccggtgattttgttgtccgatcccattacgtaattttgttctttctcaataacgttattatcccccacggcaaatgagaagttgcctcgtaccgtgttttctctaccgataccgatcgaactcattccaagcacattggaatcttgacctattgatactgcacctgtattcaatgcgtttgctccgtaccccatggcaatagatccttcatttctcgatatcgcaccatgtcctacagataccgaaccatcccccaacgcttccgttgttggtgaatccgacactttcacggatttatctcctgtaccttttagataatctattaatgcttgtgcttgaactaattccgtcgtgctttttttaccattttcaagatttattttgccaataccgacattttttccaaagtcagcttatttatcatcaatattcgagccatctacttttaaatacgccgtgcctaacttatcaactaagtcagtagtcttggtataatttttcaacgcctccgcgactgcttttgaggtaacgacttttccgttgttttcctccactttatcagctttatttaatttcagcgtaagtgtaccggcacttggagggtctttatcattagatggtgttaatgataccatgatgtctttttcagtcgtcgcactatttgctccagccgtatcgctactgctaacaggcgcgctatcaatcgtcaatgttccgcctaattgtaatgtggtttgtgtcgacttgtcgtcattgcctttaaaggtaacacctttattgaccgctgtaattagcccactaatcgcatctttataggtcgtgtatttatcttttgaaacggtagaagttgtatctgtatctgtatcatctcccttaactttagtaaatgatggtgcggtaaagttaccagttttatcaacagaaagccctaaattaccgactaaatcgtgaagttgtttaccattaatcgcatcagttgaattctctgcaatctgtccaccggcgacatttgagattttaacgtttttatccgtgtcagtttttccattcactggggtaaaagttaacgcatgtccacccacttttaactctgctgtgttcgtgctacttgatccatctgtgctactcgtattatttttaaacactaaagcgttgctgtcatctttaccaatcgactcaataccttttaagtccttattaagtgcaattgttaactcacttccactagcttttgtagtgatattttgatgttttttgttatctgtagctgtagcatttttagtttccgccccttttatagataaagtcccactgatattatcagtattaccatcatctgaagttaccataaatgcagaggctttgtttgctagcaaattatccacatattttttgttgacggcgtcataatcttgctctggatcgcctacaaatactattcttcttctatttctaggtgttccgactgataacgcattagataccgctacagattgatttcctaatactattgcattttcagtatcttcaccaacatttatacgtgagcctaataatatatttccagttccagagacttcattattagatcctaataatatattttcatctttttctattttattactagaaccaatagatatatttctttcaccacttatattattatttgatcccattacataagttgatgttgattttgaacctatctcattttcatctcctactacaaatgagaaattaccattaactttattatctttacctaaaccaattgaatttacgcctaatacatttgagccttgtcctattgatatagaccctgaatttaatgcattggctccatatcctaaagctattgatccttcattttgtgattttgcatcgtaccctatagaaatagagccttctccctctgcaattgtttttgaagaatcagagacttttacagatttatcccctgtgccttttagataatctattagtgcttgagcctgtactaattctgttttttcttcatcatcaagttttatttcactaattcccacattagatccaaattctttttgtttatcgccaatattttctccagtgattcttaaaaagtcttcttctaatgtttctgtagtagcgaaatcttttaatttatctgctaccgcttttgnnacatcggataaatctttcacatttactgcattgttttctatattctctatagaatttccaccagttaatacattattaacattacttgtggtagctccgccatcgcttggtgtagttgaacctattccacttgcaacatttttaatttgcttgctacctaaatcaagactatctttatctaatttaacagttgccttatttttaccttcgcctactgtaaatgtaatatgatgagtagaatcagcactactaaattctattttagccttatcatcttttccaatagaggtaatccctgttaaagccttattaagcgatacggttaattttttattgtccttatcaacggcggttgtaatattactatccccattaatatttaattcattatgatctttattaaggtatatacttgtgttttctccctctttaggcgtgtcccccttaaccgtgaaattagcggcgactttttctaatcttttgtctaaatattttttgttgacagcatagttatcataagtatttttcttagcactatctgacgtatcctcaggaatttcttctgtaattaatacatttttaaaagatggtgtttcttttatacctattaagatatttttgttatttttttcatactgagttctaatattatcgcttaaaaatttatcttctttgtttaaagcatcatctttaaccgttgtattcccagccttaatgattaatttatcgcctagataatgcattcctttttcatcgtcatctccactgccaaaaacaaagccactattaannnnnnnnnnnnnnnnnnnnnnnnnnnnnnnnnnnnnnnnnnnnnnnnnnnnnnnnnnnnnnnnnnnnnnnnnnnnnnnnnnnnnnnnaaattctgatttcttaaatcctgttttgtcagcgtcttcaacttccgcacccaatacattcaccgctaatttagaaaattcatcggcgacggcgtaaagttggtttccgttgatagcgtcggttgaatctgacgttaccgcacctgctgcgacgtgtttaatgatacgctcattatttttcttacctatgcttaaaacggattttttattattttcttgaccattagcactcactcctcttttgaaattaaatttaacattaatagcctctattttagcttcattaagtgcggtttcttttttagtcgcttgtgagccttgccccaasgcaatrgaatccccagckgckgtttcaaccaccgcactttskccwatggcgacaccgccctcggctttagattgggcttgataaccaataatcactgcgttttttgcwcctgaggtggcttttgtttctgctccaataagtacgctrttttytgcattttgggcattrgctttattaccaatygcaaccacatktgtattagcatattcgtcagaaccattattctcaaatcctatattaatattgttccctaacgccagtatatcggtcccgttttggattttgtttttattcccgatagaggttgtccatgctgcttttttgatgatagtaccctcagttccatctttaccattcgcaaaaaccgcaccgatggcaattgaactcttggactcttctaattttgttccgctaccgatcacaacgaccgcacttcttacatccttattagtttgtgtaactgtattattkgaacccaacacaaaygarttaggtacatcaacactgacatttgtccctatgacgatagcgttttgagcttttgagcttgccccattaccgatcgctacgccggaatcagctattgcactcgcaccgacaccgatagcaatagccttatttcccgttgcccctttgttatcataatttaaacctttttgagtaggattattcaccgacaaataatgcaaagttcctacattttttacgcctttcatcgcttcttttaattgagcaaggataacaacgtcggtatctttcgtacccggtgcgacgttgacgatttgtcttagaattgtttttttatctccgcttttttggttactgatatcggcaatatctccaccatttttcccaacagaaacgggagcatacatattaccatctagttttcctgctaattctttactaatatacgcagtgtcatttgctttattaatgcgttcatgtgccctatcagcaactgattgataacctaaagctactgcattcgcatattttgttgaagtctcatttcctaataaaattgaattacgagcttccatatcatctatcgtagcatttttccctataacaatagagttttcagcatttgatttagcccctacaccaattgccattgaacctgattttttagctccatcactaaggaagttacttttagcaaatttttctttttgttctgggttaaataatttttccaatttttctttggctgtatcctggttataagcattttcaatatctttatatgcttgttctaaccattccttgcgttttttcttttctaattcaggatcttgttttgcattctgaggtagaagtaaactataagtcttatcatcttcagtttttaatttttctgcgacagttttaaagtcgttatattttttttcgtaggcttctactttactttttatattctctaaattaatttcttcgttgtttctttcttttctcgctttgagttttaaatattcctttttaactttcgcatagtttttgtaatcctgttcttttgtgactaataactttaagtcatctaagcctttgacagagacatatttcacgccggaattaatattatcttcttctaacgtatttccatacaggatagcttcttctaaggctcttaattgagatacgttgaccgcatcggtatcgctcgcacccggtgcgacattgacgatacgtctttccgcattcttgccacccactgacaaatagccgattctttctgatgaaggtattgatatggcatttttaggtgcccatccgccttgtgccatttcagtttgagtataatcagtttttgcattgacgcccaatgcgatggaatctgaaaaagaggcttccgcaccattaccaattgccattgcatttttaatggtaaaatctgattttctattgttcttatttttttcactttgaagtgcggttggcatttcagctaaaacttttgcttttatacctaatgccatagaatcatcagcttctactaatgaatgagtaccaaaagcacctgattgtttacctaatgctcttgtgaaatttcctattgaaaatgaagattctttttgtgcaaacgcaaatctaccgagtgcaacagtactatcttctttcgcataggcatatctacctaatgagattgcattatcccccaatgcaacagagtatgaacctatggcaatagcaccttgattatgtcttccctgcctatctttagattgctctgctttttcttcgcccgttccttcttggacggttgtgtgggcattaatatgttctttcattatatcttgtatcgctgctgtatcaccgaaacgatataaatcttcaatagtgattttgttggctgttaatccttgtggaccgccattagtgtatgtagggtaattttgtttaccgtttactaataagttatattgatcaatagtaagcccttcaccattaaataccttacccatcttcacattggcaaaggtgtgatcaccaatcgctaacgatcctaagccccctgcaaaagagtctttaccatataccatagatccggcaccgatggcttgtactttattcccgatacctacagatccatctgcatagacatagctgttattacccatcaccaatgaacctttaccaaaggcgacggtgtttgagccgatagcggttgaataatccttagtcgctacagcaaatgtccctaaagcggttgaattatctccataggcaattgaacgtgccccaatagcaatggcgttatttcctcttgcccaagtatgtgttttggtatttctacgatctgctaaatatttttgataagcctctccttctttttttagatagagttcatatcttttatagtctgataatgcctttatttgttttattttttcttcatatcctggggtgttaggatcgatataatttttatatgcggcgttttctgattcaacatcataaaaattttccccctctatgcggtaatatccacctttatagtctttaccattttttctcacaaaatatgtgccgttttgatatattggtgtgtaaccatcttcagctaataactgtccttgatcattaagcataggcttaccgctatcatctttcataatctcaaaatcaacggcagcatattctttggtatagttaaaatcatttcttacattataaaaaagtctaaacatctctttagaaagcggtttggcatcatgccctgcggcattatcgctcccgatagaaatagaggaatctccccatgccaccacatcgttacccaaagcggtcgcttcttcgcctcgtgcaaaagatcgataaccgacagccgtaccttctttatttaaagctcttttaggatcttttttgcgtttctctttctccattattatcacttggttaataatgtctcgttttttttcttctgttgtaggtttccacttagtattagtggcaaattcaaaatacttttctcgtaagtctttatacgaaccatcttcgtctttgagcagaatagattttgcttcttcttgcgtaacggttggattgtgagctgaagtcgctgtattttctccggtagcggctccaaaaccgatagcggttcctttatcaccgcccacgactgctcgagaccctatcacaacagtttgattaaagtctttattgctatacgaagcattttttcctgttttattagcataatccgagaggataaccgcttcatcgggaatatcagattgtttatatggtcgattccaagatccatacataatttgcgttttacggtttagggtgcttatcgtttgtccatctgcaacatcagcactatgaacccaaacatcatacccatacgcaactccagacaatgccccmsccaycaccaaygccaacggcaggascttaaacgcccctaacatwccgccgaaaaacacaccgcacttcggytgacttcccgccgcctcaacacggctcgccacytgacggttattcgctaattcagacacaactttcgtttgaccygttgttacatcgtatttggttttgaagattttgttcataaattcactctctttaagcttttaaaattaggttwtttaataatgtatrttgtygattttttaacttttacggttgtttattgattaaacgtgttactttttagatagattgataaataaatcggcgatgccttgctttttaagacamarcaraaaaaggcgaataatactttcgccgaaaggttgaggttgaaataggtgatttttatttttaagatattgtttgaacatgtccaacctctcaaaattaacttgaaaggttgattttagccaatayactaggctgtrggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtcatttttttcgttctattttgtttgtcaagtaaaaattcggattattctatctcaaaatttttacggaaaaaacgattttttatttttttattcacttttttgtttgttatcagccaaaagatgatttttggcggcggctaaatactgaaacattgaccaaacagttaaaatggcggcgatatataggaagataatcgctgtaatttccattaatgtgttgtaacgccacaaaagaccaccgagggagagcatttgcgaagctgtttttacttttcccaaccaagaaaccgcaaccgtgccacgactaccgatttccgccatccattctcttaatgctgaaatcacaatttcacgaaaaatcataataattgcaggtatcgttacccaaaaagaatgttgatattcaacaacgagcgtgagtgccgcaatgaccataactttatcggctacgggatctaaaaatgcaccgaaacgggtactttgattccatttgcgagcaaggtaaccgtctagccagtctgttattgaggcaatgaaaaaaataagcgtagtaagaaaaggtgcccagctaaaaggcaagtagaatgccacaataaaaaaggggattaagccaacacgaaataaagttaaaattgtagggatattgagtttcataatattattttggatagggtagggatacgctgtattctaaagtatatcccttatttttaaaagtctgatgaaactaacaaagcgaaataattagttatttttgatatgagattttaacgtttgttcaatttcgtaaatccaatcaagttcatattgagtaaagccggcttgaatacgagcatcagtattaatcacacctttaaaaatcacaatgcgatatttgcgtaataattcgctgaaacatttcattgcatctaattgacgtttagcggaaagtgcatgataccaatgatttccaatagaaacatgaccaatttcatcacgcaaaataatatctaaaattgccactgcctcgacgtctttacgctgtgcaattttttcttgtagtattgggtttgcatctaatcctctggcttccaaaactctaggtaccaatgccatacgttcccaaatgtcatgagcagtcgcttgagccatttcccataagccggcatgtgcttcaaaatcaccgtattgatatcctaatgtgtttaaatgctcattcacgagagtaaagtgagtgctttcttcacgtgcaactttgagccaatcttgtatgaacggcatgccttgttcgagttcttcttgtgcgtgacgtccaaatctccacgcagcatctaaaccaagatttatggcgttaaattcaatatgtgcaatggcgtgtaatgttgccgcataaccttcgtttgtggcaaaagaacgtttcggcacattttggggagcgacaaggaagggtttgtgtggaataccgacaatttcttgttcaggtgtaacaagaggaaaatcgtccgtttgatctagatttatcgtaggcaaaatttcatcatataactgattcactaaacgacatttttcatagggatttgtttctgccagtgcggttgttattttatgccaaaagtcttgagttgaaagtgcggtcatatttttccttatttcatagaataatttttaatcgctcaaagtatagttatcagagaaagatttgcaatcggaatttgcttataggataatgcaccccattagccgttcggttaattctatggaaatcttttcggttcctcgcaatagtgtccgatttactcggtcaggttcggaagaaagcagccaaagtcggaatttctgtgtgccgagatcctgccggaaaggtttccgcccatctactacatttcaatatgtataaaaaaagcaacttttcagttgcctttattcaatttagctttgttcttttactgcctctaatgcacgcaaggcataagtataagccgcaccagcgttcagtgcaatcgcagtagccaatgctccggcaatttcactttctgttgcccctgctttagctgctttttcagcatgaacactaatacaactttcacaacgtgtcgtaatagcgacagcaattgcgatgagttcacgggttttttcatcaagtgcttcagccgcagctgcctgatctaagttaatataggcttgtaacatttttggatgagacttgcccaattcgccaaaagattttttaacatgagcggtatgctctttccaatctgtgaatgttgtcataagaatttcctcttgttgttaatcaagttaatgttgataattaaccgcacttttataacttgattgactaaaagtgcggtgtaatttgaacatattttttagatttaaattcgttcaataagttgtttaaaaaatcctttttcttgttgaatcagttgatggtaatgtccttgttcaactagatggctgttatccatgatacaaagtaaatcgaattgttcaagtgctgttagacgatgagtaaccataatgaacgttttattttgacaatgttcaaataatagcgttagaacatggcgttcagtatctcgatccagtccttctgtcggttcatcaaatagaataatgggggcattattcagtaaaactcttgctagtcctaagcgacgctgttcaccgcctgataaaggtcgcccgccgtcgcctaaccataaatccagtccttgatcctgctgaactaatttttccagacctactttttgtagtatatgacacattttttcatcgctgatttgttggctacctgctatttgtaaattattgcgtaaagtatcactaaaaatatgtactcgttgagtgagtaaacagatattttggcgtagcgtttcttcggtataaacttgaatcggtgcattagagagtaaaatttccccttggttgcaatcatagtttcgaaccaataattgcagtaaacttgatttgccactccccgtttttccgagaacagccactttttttccagcttcaacggtgaaattaatttgttgtaatgcctgatcattgcgatccggataagaaaaactgacatttttcagttgaataagcggatattcattgttttgcaatatgcgagtaccgttgaattgcactaaaggtcgttgtgcaagaagttcattaatgcgttctgcagatgaaatgacttgtccaatatgtaagaatgcggcactaataggcatgagaagctcaaatgaggcaagagcggcaaacgcaaataacgcaataaaagcattgtgataatctgcaatggaaaattgtgctttcgccgcaaaccaaagggttattactaccagtaatccgttaataaatacgacaagtgcggtagataatccgactaaatttgtttcttgttgttggtaagattgccattctaattcgattgcttttagtttctcttttgagctaaaggctgcattaaagagtaatagttccgcttgcgactgaataaattcgataaaataagtgcgataaactgaacgagattgagttaatttagcaccgaatttacgtcccagccgataaaaaacgatgggaataatcaaaagtagcaacagcaggcttataccaataaatacgccgatagaaacattaaataaacttaagcctaacgtaataaaagcaataacaatcattgcactgataaaaggggcaataaggcgtaaatacaatgtatctaaagtatctacatcagccactaaacgattaagtaaatcactgttgcgatagcgattaagtactgcggggcttaaaggaataagtttactgaatacttgaacacgtaattttgccaatacacggaaagtggcatcatgcgtcactattttttcaaaataacgtgttacagttcgaccgattgctaaacctctgacacttgccgacgggtagaaaaaattaaataatgtgccaataccggctaacgccgtggcggcgagaaaccagccggatagggttaataaaccgatgcttgaggctaatcccgcaatcattaatattccccctaaaatgagagtaaatttagcgtgataaaataagcgaagaaaaggaagtaaagctcgcattattgaatttcctgtttttgttgagccaaaagttcggcgaagaaaccttgttcttttaattgttcaaaacggccttgttgcacaatttgcccttgttgcatcactaaaatttggtcgcattgttttagatcttcaatgcgatgcgtaatcattaaagtagtttggttacggctaattttttgtaacacttgtagtacggcattttccgattttgcatcaagacttgcagtaggttcatcaagtaataataaattgctttgacgcaataatgagcgagcaataacaagacgttgtgcttgtccgacggataaaccaataccgccttctctaattagaaaatcaagtcctaatttcgcacaaaaagacgtggcttgtgcttgttctaatgcttgcgtaatttgttcgtctgttgcttgaatatcaccaaaaagtaaattttctcgaatcgtgccttgtaataataaaggattttgccctacccaagcgatattttttcgccattcgtttaaagataaatcatgcaattcaataccattaatttttaaacttccctgataatttaggaaaccgagtaacacgttgattaatgttgttttacctgcaccgctttgcccaactaacgcagtattgttttgagccgacaagcaaaaatttaacggagcggttaaaggatggccttgtggtgaaagtgcgatgagatttttcgctataatttcgaccgcacttttaggctcgatactatgtgtttgttcatattgttgagaagtaacttcttgctccaaaaatttaacgatttcatcggctgcaccaatacctgctgcacgatcatggtaataagcacctagatctcgtaaaggttggtaaaactcaggagcaagaattaagcagaaaaaaccaataaataaagtaagttcagtgtcgtaagaaccgaagttaatttgtcctaaataactaaaaccaaaataaactgccattaatgcaatagagatagaagtaaaaaattctaatactgcggaagataaaaatgccatttttagcacagtcatagttgtttcacgaaaatcttcagtgctttcttcaatatattcagtttgctcttttgctttattgaaaaggcgtaatgtttctaatccacgtaaacgatctaaaaattgaccgctaagttttgctaaggcggacatatttttttgactactatctgcggcggctaatccggctaaaatcataaaaataggaataagcggagcagtaagtgccaagattaatcctgccacccaattgagtggaaagacagcgattaagataatgattggtgtaatggctgaaagtgcttgttgaggtagaaagcgagcataaaaattgtgcagattttctacttgttccagcatcaaggttgcccaacttcccgcagatttttggttgatcattgccggaccagcttgatgaattttggcgaaaatttgttgacgaatatgatgacgtaattgttgaccgcatttaaagcccactttttcccttgcccataatattaaaccacgtagcataaaaccaagaataagtgctagaaagtgcggtattaattcacttcgatccgtatttaaaataatgagttgatgaagcaggtagcttaaaatataagtttgtgcaactaaaataatggatgaaatagttgcaagaataatattaagcgaaagcaactttttgattggcttttgttgtttgcgtagccatttgaaaacatacttttgacgtgatttttccattgttactgctagaggttatgatatatttgtggggcagattagttgccccaatacgactgagttaattatttttgtgtatccaaaaaacgttctgcatctaaagctgccatacatccagttccggcagatgtaattgcttgacgatagttgtgatccattacatctccggctgcaaaaactccttggacagatgttgccgttgcattaccgtccaaaccggattttacgacaatataaccgttgtttaattcaagttgattggcaaacaattcagtgttaggagcatgaccgatcgcaataaataccccttctaatttaagatcttcaacattttctgtttgtgtgttttttaaacggattccggttacgcccatattatcacctaaaacctccgctaaagtgcggttcgtatgcaggataatttttccttcttccacttttttattgaggcgatcgattaagattttttctgcccgaaacgtatcacggcgatgaattaaatgaacttcagaggcaatatttgcaagatataaggcttcttcaacagccgtattaccgccaccaaccacagccacaggtttattgcgataaaagaagccgtcgcaagttgcacaagcggaaacacctcgtcctttgtaagtttcttctgaaggtaagcctaaataacgagccgatgcacctgttgcgataatgagtgcatcgcaactgtaagcccctgcatcaccaaatagtttgaatggaggttcagataaatcgacattattaatatgatcgaagacgatttcggtatcaaatttttcagcatgttgcaacattcgttgcattaattccggacctgttgtatcgccaaagtctcccggccagttttcaatttcagtagtagttgttaattgcccaccttgttgtaatcctgtcaccaataccggttttaagtttgctcttgccgcataaattgcagcagtgtaaccggcaggaccggatcctaaaataagcagtcggctatgtttaatatctgacataaaaatccttgttagtgaaatgttacaagattgcgaattcgcttattatagagatttcaagaattaaatctataattaaatagaaaaccatagtggctattatgttgctggagacactatttttaacattaatatttgactgtatggccataactttcaatgatagatttgatatgttccagcgaatccttggttggcggtgctacatcttccagttcatattgttcgcccatcgtcttccatttatgtgcacctagtcgatgataagggagaagttcaacttgttcgatattgctcatattttgaataaattgacccaataagtgtatatcttcatcagcatcagtataaccgggaacaactacatagcgaatccaagttttttgattgcgtttttgtaggtatttggcaaattctagtgtacgcttgttcggtacaccgataagattttggtgcactttatcattgagttgttttaaatcaagtaaaacaagatcggtaacatctaataattcatcaatgacatgatcataatgacgtacaaagccatttgtatccaagcaagtacttattccttccgctttacaggctttaaaccaatctcgaacaaattcagcttgtaagacagcttctccaccggatgcggttacgccaccgcccgttgcattcataaaatgacgatacgtgaccacttctttcattaaatcttctacactgatttctttgccatcatgtagatcccatgtatctcgattatggcaatatttacaacgcattaggcagccttgtaaaaataaaatgaaacgaattcccggcccatcaacagttccacaagattcgtaagagtgataacgtgcaagtacagacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacaaaaaatggcggtaattatatcatgcactattaatttgtaacttattctttggattgttcgggaataatgacccctaaatcgatccatttgtaccaagtttgttgtagaaattgtagtatgttttcgtcaactgcaaggttttttaaagattcttttagcttttgtagtgaataggctttttcttgtaacagcattaataaaaagtgatctaagtccgttaacttttggtaatacacttcaaattgagcattacgccaaacaattgtttttgatggttgattcagtatttggttaaactgagttgaaagaaaatccaccggatattcttttataaagcaaacctctgagcatttcattggagtttgttctgttatatcgaattcagtcggtagctgaaacattgatacttccgcttgaagttgatcaaattcaaattgcattagggagagaatattttcatcgaaaatatttttgtgttggcaaaattgtaaaaactcacctgcaatatcttggaagtaaggggaatgtgcttttccgtttttgacaaattcttcttttgcattatcccaatcttgtcggtttaaatgagccggagtttcggtaaagcatttttcgataaagccaaaagtattgttgcgtaataaccgcacataaatatttaaacgtctaggatcgtgattgctagagtctttttcacgaatagcttgaacaaattcttgttgcgtttgtgctagatttttagccatgacaatcctctttttttgacatatttttgttgtaattgatggataatatcgacttctttacaaagtttttcaaaaggggggaaattgaaatcacgttcaagtagtgttggtggcatatgaggtaaacgagcataagtatattcaagtaaatcccaaacagtaccttttacattttcaccatgtgtatcaacaagtaattgaggaagatggcgaaaatctcctttgattgtattgaaagactctgatgtttgtatttgcacttcagtagcggcatgttcatcatcatgtccggcaatatgaatgtaattgacacgttttaaatccacattatcaataaagacatgaggatcaagtaatccatggttgaccgcatttacatagatattattaacatctaaatgaataccgcaatttgcctcttgtgcaatagcattgagaaattctacttcattcatcgtgcttgtttcagaatgcaaataataagaggtgttttctactgaaatttgaatttctaaaaaatcttgtacttcacgaattcttgctgcagtgtgttttactgcttcatcagtaaacggcattggcaataaatcatataaatgaccatcgcattcgcaaaagctcagatgatcggaaaagaaaggcgtattatattgttttatcatggctttaatgcctgataacaattctttatctaaaggggcttgtccaccaagagaaagagataacccatggattagcatagggattttttctgccactttatcgaattgataacgcgcaaatcctcccatttttaaccagttttccggtgctatttccataaattgaattcgatcattattgcgtaattgtagaaatccttccgctagatcacgtctgtagcctaaaccggcaccttgtcgcatatatcctccgtgtaaataaaaagggtgcgatgcaccctcaaaaatttatttagatgcaccgcactttccttcgccacatttgccttcggcagatttcggcatatttttcttaggagcggttgcaccgcattttccttcaccgcatttgccttcggcagattttgatacacatttgccatcgtgcatttcacactcggttgtgttttttttcatatctgcatgtgctgatacagccatagctaaggcaccggctaaagcgactaaagttgtttttttcatggtttttctcctatataaatgattaaagtaaattcagccgtttttgagctgagtattttttccgtaacagaaaatcaagtgaaactacacccgcaccttgtaggagcagaggaagtaacgtaattatgtaaatgagcggtaatttataaccattgttgcatacgttataacctaatccgctatgtactgttgcccaagctacagcggttaaaatcatcaaccctaaagcactaaagcgagttgcaatacctaaaaccaacaaaatcggaaacaataattctgcaccggttgcaatagcccaatttaagtctagtggtaaaattgagaaaggaaacggaaaattatcttttatcgcataaaaccaattttcaccgttccatttttctagtcctgcttcgaaaaactcataggcgacaaaaaaacgtaatacgagtaaggataatccctgagtggattgtttaaaaatatgacaatgagacattttctactcctaaaaaattgctttctagaagttagacgaatgagaaaataaaaccttacaaaaaaatttcaaaaatttagaaaaataaaaaggtcagattttactctgaccttttaaatattctgatttaaaacttacattgacgttgtgaatgtacgtgtaattacatcttgttgttgctctttagttaaagagttgaaacgtactgcgtaacctgatacacgaatggttaattgcgggtatttgtctggattttctaccgcatctaataacatttctcgatttagtacattcacgtttaagtgttgaccgccttcaatagttgtttcatgatggaaatatccatccattaaacctgccaaattgcgtttttgtgcatcaatatctttacctaacgcattaggtacgatagagaacgtataagaaataccgtctttagcataagcaaatggaagtttagcaacagaagttaatgatgctaccgcacctttttgatcacgtccgtgcattgggtttgctcccggtccaaatggtgcacctgaacgacgaccatcaggtgtgttacctgttttcttgccatataccacatttgaagtaatcgttaaaacagattgagttggtgttgcattgcggtaagttttgagtttttgaattttcttcatgaaacgttcaaccaagtcaactgcaatatcatctactcgtgaatcgttgttaccaaattgtggatattcaccttcaatttcaaagtcaatcgcaacattttttgaaataccgatcacgtcgccagctttatttttcacttcaatatcaccacgaataggttttactttagcgtatttaattgcagaaagtgagtcggcggcaacagaaagaccggcaataccgcaagccattgttctgaatacatcacgatcatgcaatgccattaacgctgcttcataagcatatttatcgtgcataaaatgaataatgttcaatgcagtgacgtattgttttgctaaccaatccataaagctgtctaaacgggtcatgacgtcttcataatctaaatattcagttgtaataggatcggttttaggaccaacttggtcaccggatttttcatcaataccgccgttgattgcatacagtaatgtttttgctaagttcgcacgagccccgaagaattgcatcattttacccacgatcattgggcttacgcagcaggcgattgcatagtcatcattttggaaatccggacgcattaggtcgtcattttcgtactgtacagatgaagtatcaattgatactttcgcagcatagcgtttgaaaccatcaggtaaactttcagaccaaagaatagttaagttcggttctggtgaaggtcccatcgtgtaaagtgtatgcaagatacggaaacttgttttggtgactaaagtacgaccatctaaccccataccggctaaagtttcagttgcccacattggatcaccggagaataattgatcgtattcaggcgtgcgtaagaagcgaaccatacgaagtttcatgaccaagtggtcaattaattcttgagcttcttgttctgtaattttgcctgctttgagatcacgttcaatgaaaatatctaagaatgtggatacacgaccaaaagacattgccgcaccgttttgtgattttacggcagcaaggtaagcgaagtaagtccattgaaccgcctcttgagcattttttgctggagcggaaatatcatagccgtaagatgctgccatttctttcattttgcctaaagcacggtgctgttcagcgatttcctcacgtaattgaatcgttgcttgaatatcttcgccgctttctaatttctcttgtaatgaagtaaattgtttgaatttatctttcattaagaaatctgcaccataaagtgccatacggcgatagtcaccgatgatacgaccacgaccgtaagcatcaggtaaacctgtgattacacctgatttacgacaacgtaaaatatctggtgtataaacatcgaatacgccttgattgtgagttttgcgatattcagtaaagattttttcaacttctggattgagttcacgacggtaaactttacatgagcctctaaccatgttgattccaccaaacggcataattgcacgttttaagggagcgtctgtttgtaaaccgacaattttttctaaatctttattgatatagcccgctttatgagaagtaatagtggatggaatatctgtgtcaatatcataaggttcgtgagttttgttctccactttgattttttccattacatcagcccacaggattgatgttgcttctgttgcttccgctaagaatgcttcatccccctcatacggagtatagtttttttggataaaatcacgaacattgacttcagtttgccaatctccaccgacaaaaccttcccaagctttttgttgagtttctgttaattgagccatcgctaataacttccttttgagtaaataaaaataaaactgttgaactttgtaaaaacaatcgaaaaacagaccgctcttacaccctaatgatttattagtgtctatgaggtttattggtaaaccattgcattaatgcaatacaaacaccaccgccgataatatttcctaaggtaacaggaattaaatttttaaagataaaatgatagatgtccaaatcggcaaattgcagtggattcatattaatcgcttgccaaaaatctgttgagctggcatgtgaggtaattattcccatcgggatcataaacatattggcaacactatgttcaaagcctgaagcaacaaacagagcaataggtaagatcataatgaatgctttatctattaatgttttaccggcataactcatccaaacggcaatacataccataatgttacatagaatacctaagcaaaatgcttcaagccatgtgtggtgaattttatgttgtgctgtttttagaatggttaaaccccattgtccatttgccgccatagtttgaccggcaaaccaaattagcaatacgataattaatgaaccgacgaaattacccagataaacgacgagccaattttttaacatttgagttgtggaaatgcgtttattcacacgtgcaataagagacatagttgatgatgtgaaaagctctgaaccgcatactaccgccatgataataccaagagaaaaaaccagtccgccgaccagcttggtcagtccccagggggcattacctaaatctgtttgagtagtcgtatagaaaacaaaagcgagagcgataaatgcccccgcagaaattgcagataagaaagaatagcattgatttttagttgctttatagacacctacattctcaccgatttgtgccatttcgctaggtgatactattatggttgtattttcggttttcattacaaaccctattgaaattaaactggcgttattttaagtcattaaccggaaactttaaactaaaaaattttttattttttataaaatttgttaaatgaaaatatttttaacaagtgtttaacatttaattgttttatattttttaaatgcaacaacttattaacattggcaatctaaattgctatttaaagggatttctgatacaaaatgcacctattatttttatatcatgggagaacaaaaatggtagaagaaactatttttagcaaaattattcgtaaagaaattccggcaaatattgtttatcaggatgaattggttactgcatttcgtgatatatccccacaagcacctacccatattttaattatcccaaataaaattattccgacagttaatgatgtaacatcagaggatgaagtaacgttgggacgtttatttaccgtagcggcgaaacttgctgaaaaagagggaatagcacaagacggttatcgtttaatcgtcaattgcaataaacatggaggacaagaggtctatcatttgcatatgcacttggttggcggtgaacctttagggaaaatgttggcaaaataatgaaaaatttacttatcgctgttattttgagtttgggattaattgcttgtagttctttggaaaaagtaaatttagtgcattctcaacagccaattataaatattagtaccgagcttgcttctgatattgacgtacaagtcagccattcatcagcatcgctgacaaacgtttcacaaaagcaagtgacgctcgtatattattttttttggtacgataaaaatggtgtaacacaaggtgatgtggctaatatgaaaaatgccactatgctgattttatcgccaggtcaaacacgtcagttagtattacaaaagccgacaacagaaagtgtgaattaccgcctttacttgagtttatagaacaaaatgtcgatattattaatagatttatcgggtcaagagttacgtcaagaagaaatcgaattacttgaacatcctctagtcgcagggttaattttatttagccgcaatttttatgatattgagcaaatccgacatctcattagatctgtgcgtcaaaaggttaaaaagcctttattaattactgttgatcaagagggtgggcgagtacagcgttttcgtcagggttttacgcaattaccggcaatgcagtcctttgcctgtttactttctgatcctcaagagcaacaggaaatggcttggcgagcaggttggcaaatggcggcggaaatgaccgcacttgatatcgatcttagctttgcacctgttttggatcttgggcatcaatgtaaggcaattggcgaccgcagttttcattatgaggaaaagaaactgattgaacttgctgagaaatttattcaagggatgagacaaatcggaatgtcggcaacgggtaagcattttcccggtcatggacatgtgttagccgattctcatttggaaacaccttatgatgatcgagcaaaagaattaatttttgcacaagatattcgaccgtttcagtctttgattaaacaagggttgttagatgcagtgatgccggcacatgttatctacactcaatgtgataatcaaccggcaagtggatcgtcttattggctaaaggaggttttacgtcaacaattgggattccaaggagcgattttttctgatgatttgggtatgaaaggtgccggttttatgggggattttgttgctcgttgtacgcaatctcttcaggcgggttgtgatttattgttgttatgtaacgagcctgaagcagtggagcaagttttagatcgttttaaaccacaggaaagtcagaataaacgaataatacgccaaactagattgaataaattattcaaaaaacaacggattgattggcaaaccttacgcactcaacgtgattggttggaaaatcacaaaaaacttaccgcacttcagcaagattggttagcctatagggggtaggacaattagaaattatggaggtggttttttgagagtatacaaaaataaagaagaactcaaaactgaaataaataaagcatttaagaagtatattttagaatttgataatattccagaaaccttaaaagataagagagttgataaagttgatagaactccagctgaaaatcttgcttatcaagtgggatggacaagtttggttcttaaatgggaaaaagatgaaagaaaggggcttcaagtaaaaacaccatcggatgaatttaagtggaatcaacttggtcaattatatcagtggttcacggatacttatgctcatttatccttgcaagagttaaaagcaaaattaaatgaaaatattaattctatctatgcaatgattgattcgttgagtgaggaagaattatttgaaccgcatatgagaaagtgggctgatgaagcgactaaaacagcgacttgggaagtgtataagtttattcatgtcaatacggttgcaccttttgggacttttagaacaaaagtcagaaaatggaagaagacagcattataaattacctttttacaaaaaaatttcataaaaacagttaccaaaggcaatagagaaaactatcgttttttcctttgcaaatttaaattttattaaattaatatgaatttaattcatgaaaagtataatttttctgaaattgacacatattttctttctctttatgatgattttaaccgatttaaagataaatttattatggagtaaatgaatatgagttataccaaagaattagacacattaaatcagcatatggttgatattaatgggaaaattaatgtttcttttgagttttttccacctaaaaatgaaaaaatggaaactcttttgtgggactctattcatcgtttaaaagtccttaagccgaaatttgtatcagtaacctatggagcaaattccggtgagcgggatcgtactcatactgttgttaagcgtattaaacaagaaactggtttagatgcggcaccccatttaaccggtattgatgctactccggaagaattaaaggctattgctaaggattattgggatgggggtattcgtcgaattgttgctttacggggggacgaacctaaaggttatattaagaaacctttttatgcctccgatttagttgagttattacgttcggtagctgactttgatatttcagtggcggcttatcctgaagtgcatcccgaagcaaaatccgctcaagcggatttaattaatttaaagcgaaaaatagatgcaggagcaaatcatgtaatcactcaattcttttttgatgttgatagttacttacgttttcgtgatcgttgtgcctcaatagggattgatgcggaaattgtaccgggcattttaccggtaacgaattttaaacaattacaaaaaatggctgcgattacaaatgtcaaaattcctagttggatggcgaaaatgtatgaagggttagatgatgatcaaactacaagaaatttagttgcggcaagtattgcgatggatatggtaaaggttttatcttgtgagggggtaaaagatttccatttctatacactcaatcgcagtgagttaagttatgctatttgccatactttaggcgttcgcccaagtttataaaaaaccgcactttgggcctaaaaaaggactaaattgttaaaatttggtccttttatttttacggattttattaagaaatgcacaatttaaaatggaatgtcatcatcaagtggagcatcaacaggtgatggagatgcaatgctcggtttaggttgagaatgtgattggtaggttggttgctgttgaggttcgtatcctcccatttgtccacgatctgaacgactatccagcatttgcaatacatcgccctgaatttcagtggtataacgatcttgaccattttgatcttgccatttgcgtgttcttaaacgtccttctacataaacctttgagcctttacgtaaatattctccagccacttctgcttgacgacggtagaacacgatacgatgccattctgtaatttcacggcgttcattggtatttttatcaatccaactttcacttgttgcaacactgatattcgcaacagcatcaccgtttggcatggtgcgaatttcaggagcgttaccaagatttccaacaatgattactttatttactccagccataagtcctctaatttgcttcagttaaaaagtgcggttattttgccttaaattaaaaaaaaaagctatgcttaaaatgaactaaactggatatttgcacagttgtttaggaatgtgagataatgatcgcaaaatttacttgattggcttgctattattgtcaatttattgttggtgtattatggaaaaaattgatattcgtggggcaagaactcacaatctaaaaaatataagtttaacaattcctcgtaacaaacttgttgtaattacggggctgtctggttcaggaaagtcttctttggcttttgatacgttatatgcagaggggcaacgccgttatgtagagtcattgtctgcctacgctcgccaatttttatctttaatggaaaaacccgatgttgatcatattgaaggattatctccggctatttctattgaacaaaaatccacttctcataatcctcgctcaacagtgggaacgattactgaaattcatgattatttgcgtttattgtttgctcgagtaggtgagccgagatgcccagaacatcatgttacattaagcgtgcaaactattagccaaatggttgataaagtgctgagtttgccggaagaaagtaagatgatgttacttgcaccggtggtcaaaaatcgtaaaggcgagcatattaaaattttagaaaatattgccgcacaaggctatattcgggcaaggattgatggtgaaatttgtgatttatcggatccgcctaaattagaattacagaaaaaacatacaattgaagtggtggttgatcgctttaaagtgcggtctgatttggctactcgtttggctgaatcttttgaaacagcgttagagttgtccggtgggacagcaatcgttgcggatatggagaattcgcaagtggaagaattgattttttccgctaattttgcttgccctcattgtggttattctatccctgaattagagccgaggttgttttcttttaataatcctgccggtgcttgttctacttgtgacggtttaggcgtgcaacaatattttgatgaaaaacgtgttgtacaaaacgcatcgatttctttagccggtggagcgataaaagggtgggatcggcgtaatttttattattaccaaatgttgatgtctttagctaagcactatgattttgatattgaactaccttttgaaaagttaccgaaaaaaattcagcaaattatcttaaacggttcaggtgacgaggaaattgaatttcaatatatgaacgatcgtggtgatgttgttcttcgccatcatagttttgaggggattctcaataatatggctcgccgttataaagaaaccgaatctatgtctgtacgagaggaattgtccaaaaatattagtagtcgaccttgtgtagattgttgcggttcgagattacgttcggaagctcgccatgtttatatcggtgaagctaatttacctgatgtatcagagaaaagtatcggagaagcactcaattttattgataacctgacattgacgggacaacgtggacaaattgcagacaaaattctgaaagagattaaagagcggttacaatttttagtgaatgtggggctgagttatttatctttatctcgttcagcggaaactttatccggtggagaagcacagcgtattcgtttggcaagtcaaattggtgcaggattagttggagtaatgtatgtacttgatgaaccctcaatcggtttacaccaacgagataatgagcgtttattaaatactttgttgcatttgcgtaatctaggcaacacagtgattgtggttgaacatgatgaagatgctatcatggcagctgatcatattattgatattggtcccggagccggtgtgcatggaggaaatgttgttgcacaaggtaatgcacaagaaattatggctaatccaaattctttaacaggtaacttcttgtcaggtaaggaaaaaattgaaattccgctgaaacgaaccgcagttgataagcaaaaaatgcttagattaaaaggagcaagcggtaataacctgaaacaggtgaatttggatattcccgttggtttatttacctgtataacaggtgtatccggttcgggaaaatctaccttaatcaatgatactttatttccattggctcaaaatgcgttaaatcgtgcggaaaattcccagtttgcaccttatcaatcaattgagggacttgagttttttgacaaagtgatcgatatagatcaaagtccgataggtagaacgcctcgttccaatcctgcaacctatacagggttatttacgccaattcgtgagttattttccggcgtgccggaggctcgagcgagaggttataatccggggagattcagttttaatgtgcgtggcggacgttgtgaagcctgtcaaggtgatggcgttatcaaggttgaaatgcactttttacctgatgtttatgtgccttgtgatcaatgtaaaggtaagcgttataatcgagaaacgttggaaattcgttacaaaggcaaaactatccatcaagtgcttgatatgacagtagaagaagcacgagtgttttttgatgctattccaatggtagctcgtaaattacaaacgttgattgatgttggtttatcctatattcgtttaggtcaatcttcgacaaccttgtccggcggagaggctcaaagagttaaattggcaacggaactttctaagcgagatacagggaagacgttatacattttagatgaaccgactacaggattacattttgccgatattaaacaactcctgaccgtcttacattgtttacgtgataagggaaataccatagtggtaattgaacataatctcgatgtaataaaaaccgctgactggatcgttgatttaggaccagaagggggaaatggcggaggacaaattattgctaccggcacgccggaagaggtttgcctagttgaaggatctcatacggcgagatttttaaaaactatgttggctaaaaaataacatcataaattagaaaccgtacttcatggattcgattttaataaagtgcggttttttctttgctttttataaaaaagttctgttacaaagggtgtttttttgctaaatttagcacaattttttcgttaagctcggtagagcgtttttatacaatttattagcggacttcttatgttattcaaaaaaattcgtggtttattttccaatgatctctcaatcgatcttggtacggcaaatacgttaatttatgtaaaaggtcaaggtattgttttggatgagccttcagttgttgcaattcgcaaggatagagcaggttcacttaaaagtattgcggcggtcggaaaagaggctaaattaatgttgggtcgtacgccaaaaagtattgaagctattcgtccaatgaaagatggcgtcattgctgatttttttgtcacagaaaaaatgttgcaatactttatcaaacaagttcacagtggcaattttatgcgaccgagtcctcgagtgttggtttgtgttcctgctggagcaacacaagtcgaacgtagagctattcgtgagtcagcaattggtgcgggagcgagagaggtttacttaattgaggagccaatggcagcagctattggtgcgaaattacccgtttcaacggcaacaggatcgatggttattgatattggtggtggtacaacagaagttgcagtgatttctttaaatggtattgtttattcttcttctgtgcgtattggtggtgatcgctttgatgaagctattatcgcttatgttcgccgcacttttggttcaattattggagaaccaacagcagaacgtattaaacaggaaataggtattgcttatattcaaaatgatgatgaagtgaaagaaatggaggttcatgggcataatttagcagagggagccccacgcacatttagcttaacttcaaaagatgttttagaagcattacaacaacctttaaatggcattgtgaccgctgtacgtacagcgttagaggaatgccaaccggaacatgcggcagatatttttgagcgtggtattgtattaacgggtggtggagctttattgcgtaatattgatgtattgctttcaaaagaaaccggtgttccggtaattgttgcagatgatccattaacttgtgtcgctagaggtggtggtgaggctttagatatgattgatatgcacggcggcgatattttcagtgatgaaatctagttttaacaacatgaaaagtgcggtagattttaccgcactttttgtcttaactatttaatctgttgtgataaatcaatctttatgaaacctattttcagtaaatcacctcctttaggtattcggcttattttagccgtggtagtttctatcactttaattctgtttgatggcaaaactagtgcaatgattaatcttcgtggttttatggaaactgcggtaggaagtttatattatttagccaatacgccacgtgttatactggacggtgtatcagaaaatttgatcgatacaaataaattgcaaatcgaaaataaagtattacgtgaacaattacgagaaaaaaatgctgatttgctcttgttggatcacttaaaagttgaaaatcagcgtttacgtttattgttaaattcgccactaagaacagatgaatataaaaaaattggtgaaattttaaccgctgaaacggatgtttatcgccaacaagttattatcaatcaaggtgcgaaagacggtgcttatgttggacagcctgttattgatgaaaaaggtgtggttggtcagattatttcagtgggggaaaatactagtcgagtattattattaactgatgtcatgcattctttacctgttcaagttttacgcaatgatgtacgtgtaattgccagtggaacagggcgaagtgatgaattgactttagagaatgtgccgagatcggtcgatattataaaaggtgatttgcttgttacgtctggacttggggggcgttttttagaaggttatcccgtcgcaattgtggaaaatatttctcgtgatagtaaaaattactttgccactattacagctaaacctttggcttctatagaacgtttacgctatattttactactttggccaacgcatgaagatatgcgtaaagcacaatctctgacacctgaagatgttcgtaaagcagtgcaacaacgtctagaaatgcagcataattcttctctatataaggtgaaaaagactccggtacaggaggaattttttccatctaataatacagatgagtattcagtagatatattagaaaccttaccggaaaatttacctgagcaagagtttctacaaaaagagcagggggatgaaaattaatgaaaataaaatttttgttacaaattttagtgattagcggtttgtttatttttacttttgctcttgaacttatgccttggccagtaacttttcagagtttcaaaccctcttggctagtgttggttttgctttattggattttagcgattccgaataaaatcagtattggtaccgcatttatattaggtattatttgggatctaattttgggctcgatattaggtgtgcatgctttggttttatctgtctttgcatatttgattgcaattaatcatttggttttaagaaatttatctttatggttccaaggtattcttactattttatttgttatcgctattcgtttttcaatttttttgatcgaattctttttaaatggtgtacattttaattggcaagcgatttttggagctatcacaagtgggatattatggccttggttatttttattattgcgtataattagacgaaaattagatttaagatagttttgttcttgcgaggattaagtaatcacatgccaataatcacacaatttccaatggagttgactttttctaaagttgtttttgttgtgttatgatctccaatgggaccaatgacaactctgttccagttttcactacgtttaattttagcatcgaaaccggcaatagataaacgtgcttgcatgttttctgcttgagcacgatttttaaaagccccacattgcaagccaaatttcttttccggcgaatttacagtagggttgttttgtatagactgtgctgtttgtaccggctttgcggacacaatatctattttctcacgtcttttatcttctttaattcttgcctgttcagccgctttttgctctttttccatttccagcaaaattttcttttgctcttcgcttaaacgaatatcgttatttaacgattgattattatcaataggaactgttcttgtttctagggctttaatgtaactccatacttcttccggtggggtagggaggacgcttttgggtttttcagattttacgggtacctgtatagttgtattcttcgttttggttttcaaaaaatacaacccagccacaaagccaataatgatcaaaagaatcaaggtaattaagaagattttatgctttccttttgtctgttttttctttttagacttcacacctgttccgtaatcttttgccacaataaaatcctgaataacgagtaagtaataaaaatggcaattctactcaaaaaactataactaatctagtactagctcaaatccagcggatctatatctaaaactaaccgcacttgttgtaatcttaaaaaattttcttgctgaaaagagtgtaaaatttgttgtaattctgctttggatttatgttgtaataaaaggtgccagcgatattgccccgcttttttgctaaaaggtgcttggataggccccaagatttgcaagtttttgcttgaggtattatgaaaataggctgcaatttggtgtaacacttcctcagctttttgtgagtggcgactttgggctttaaacagtgcttgagcactgaaaggcggtaaccccatttggttacgcaaagtgagggcttgttgggcaaagtaagggtaaccttgacttaataaactaaccaataaaggatgttccggatagtgggtttgcaagacgacctctccttgtttttcttctcgtccggctcgtcctgcaacttgaacataaagttgggctaaacgttcttctgcccgaaaatcagtagaaaaaagtgcactatccacgtttaacagtgccactaaagttacattggggaaatgatgccctttggctagcatttgtgtaccaattaaaatttggcttttgcctaattgaatatcccgtagatattgttccaattttccttttcgagcggtactatctctgtcaatacgggtaatcttatagtttggaaaacgttggtttaaactttcttccaattgttctgttcctaaacctgtcgtcactaaatgtgtcgaaccgcaatttacacattgcattggaataggtttttgtgttccgcaatggtggcaacgtagaactcgctgatgttgatgataagtataaggcttttcacaatattggcattctacaatccagccacattcatgacaaagtagaacaggtgcgaaaccacggcggtttaagaacaataaaacctgatttcccttttttaagtgatttttcatcattgtcaacaaggtttcagataaaccgttatgtactatttgtcgctttaggtcgataaccgaatgacgaagtgcggtagtatttcttgctctttttttgagtgtgatgtgacgatatttgccttgtcgcacattattgatgctttccaaacttggcgttgcagatcctaacacgataggaatatccaattgtttagcgtaaactactgcaagatcacgagcatgataacgccagttatcttgttgtttaaatgaaagatcatgttcttcatcaacgataattagccccagttgtttaaagggagtaaatagtgctgatctcgtgccgatgatgaccgcactttcgccatttttagaacgttgccatactttcaaacgttggttatcatttaaatttgaatgtaacacatcaatttcaatattaaatctcgcttgaaagcgttgtactgtttgtggcgtgagaccaatttccgataccagtactaaaatttgtttctcttgttgtaaaatttcctcaataaattgaagatagatttctgttttacctgaaccagttacgccttctaataaccaacagataaatccggattgaaagattaattggctgagtgcaagagcttgctcttggttaagggaaaggcgatcgttagtttttacaatagattgatgatttaatttttgttgccaagagatacttgttttatgtatttcttgttcagatatataccccttactttttaaggtgctccaaacttggttatgaaaaggattgttatttttttctgtgatattgttttgtagataatgtagagcctcaagctgtttttttgctctttttaatttgttattgtctaatgcttgttgcccctgttccgttagttgaaagaaaaatgttgatttttctaccgcactttcaccacggcgtaatttgcttggcaagctgcttattaatacttctcctaagggaaattgataatagtccgctccccaatgtagtagacgccataattcaggggtaaaaacagaatgatgatcaagaacggagataatgggtttgagttgtgaaatatctatctccgttttttcaggtaactcagtgacaataccaattaatttttgtcgtccgaaagggactaatactcgacagccgataggggttgaaagggcatttggaataagataatcaaaaaaactaaacagaggaacggcaagagcaactcgtgcaagtttcattatgttattttccttacgtagtttgtgtgatttcatctcgtttaacttcatcccaaaaaatatccatttcagttaaagaggtattttcgaaggttttgtgtgcttcacgcaatttttgctcgacagcacgaaaacggcgttcaaattttttattggctttacgcaagctttcttcaggattacattttagatgacgacttaaatttactaccgcaaaaagaagatcgccgatttcttcttcaatttttgtttggttgataggatttgtttgatattcctgtttaacttcttctaattcctcttgtactttagctatcacaggattgacattattccagtcaaaacctattttggcacagcgtttttgtaatttttcggcacgcttcaatgccggaaaagcatggggaatattatctaagattgattgatgtcctttttgaatatattcacttgcttttgctttgttccaattttctaatgcctcgtctgcattattggctttttgttctccgaatacgtgtgggtggcgacgcaagattttttctgtaacggtatgtactacgtcatcaaaagtaaaatattgatcttccgtagcaagttggctaaaaaatacaacttgtaagagcaaatcacctaattcttctttcagatcagacatgttattttgctctattgcttcaatgacctcataagtttcttcaattaaacaagtgatcatcgaacgataattttgctttaaatcccaaggacaaccattattaggatctcgtaattgggcaatgatacgaataaaatcttgaatgtggtagctcataaataatctcatgaaataaatagtatttgaaataaggatatcatagccttgaatgaacaaaaaaatgaaaaattttttaaatttttagccacactgtcccaggaaatgacgatgaactatcatttgataaatatattgggtcgatgagtgcctctattatgtgatgagtgcaccaagactgacaagcatttttttgaatcaaatattaaaaaattatgctcatttctaaaaaaacattttgacatcttgatgtttttagtttgcaagaaaaaagccatagattaacgaggtatttggtttatggagctgacttttattttttattttattcacataaggaaggtattatgttaaagaaattagacccaagtaaagttgttggacttaaaaaccaatcgaactgcaaaacaattatgacaattggtgttcaagacaagaaataactccagttgagaagacactaggttgcaatctagtgtctttttttattaattagattttaaggataatgaatgaactttaattatatttataatccaaaccagtctttggcgattgcgttgcatagtgcaaataaccaaaagattgtagattctttttattatttattggatgtctgtgatgaaatcttggatgtaaactccaaagaaaatataataaaaggcatagattttataaaatccaattcgatattgagaggtattttatttcactttgtcaatcatcttgttaagtcaatttctaaaaatgatattgatgaaataaaagatgtatttacttattttaataattttatcttattttatagccgagaaaaaataattttttctggtgtaggaaatataggtaacttatatctaaatcagtttaataaaattaatgatgatgcctatgagttttcttgtgcacctatcaaggataatttaattaatgaatataggttaaaaattaataatcttatgaaatttatcagagatattgatttagaaacctatatggaaattgagaatatagtcgatgatatatatgtatttggtgtgaattttaaagatagtcaagaaatgatttattctggtagtgattttgacaaacttggttgtattttctttaatgaagatatttttttagataaagatgatttgtttatcttggataagattatacatgaatccgctcatcagatattattgtctgtaatgatacatgatgaagttgtgctaaattcagatgatgagcgttatccatcacctcttagaaccggactaagaacaatgaatggtatatatcatgcagcttttgttttgtatcggatagcaagatcaagattttttaatcaaattattgagagaaaaaatactcaatatccttataatcatttgatttcttattttaacaaaaataaagaacaatttttggtttgttatgatgttatttctaaaaatggaaaattaacagatttaggaaacgttatcatcgaaaactattataaagaattaaggagtatgtctagtgaaattgacagataagctatctaaaaaaaccattgaattgatgcaaagatttaatgataatgcggtaagaagactaaatgatgatttatatccaatagcaccagatttggtcgaaatgcttattgattcaatttacggtaatgtttatcaaagaggtgttttgagtattaaagaaagacatatagcaacgctatcggcacttattgccattgggggctcagaaaggcaattgtcgtttcaagggtttgctgcttataagcttggtatcacaaaagaagaaatccaagaaatattgatacaaaatgcaatatttagtggatttacgagagcgatgaatgcggctgttgtgcttgatgaagtgtataagaaatatttacaagggaaagatgatgaagcttaatgatttttatcgttatcaattagcagaagttatgcttaatactggcataagaactattggatttttgtttgcttggcttatgctcactacctttcatcaacctcagcatttaggtgtttttattggtatttcttgggcgtgtcaggtgttggcattgcttttattttcttgggtgtgcaaccagtctacatttattatttatagtaaaaagttattgttgcctttttgctttatttgttttttgttttttttgacattgttttttgtttataattattttatttttggcatagtttttatcgttagttctgtttttaccattctcttgaatccattggggacgagtcttaccaatgatttgtatgatggtgaagataaatcaaatggatttaaattgcgtggttttgtgaattctattaataccattatttcccctgctatttccggatttattattcactattttaatacacagaagattattgttttttgtatcctattatctttattaagtggtttcttattttattttataaaaaatataaaattacaagaaaacttgggaaaaaaatctaaaaacacccttaaaatactattgaaaaaccctattgaaaaattgatggtttgtgtatcattattagctaattttattatcactcctattatttcatatattattccttacaatatatccaacaaatttaatttatcggcattttatatcggtattagtgaggctttctttggtatcggtatgataataggtagtgtttattttctaaaattgtttaataaaaaacttggcagtcatcatagtttggtattaagtattttcttggtgatgataggtattttgttttctgtgacagataatttttatattttttgtttttctttaatgacgattggggttggtgttgtgatgtttaatattaacagtacacatattcgctgtacggcaactcccaaaaatattcgtaccagttttgaatttgtttttttagcgtgctgtattgtatttattccaattggcgtattgttaacgacttgggtattaaataatggagctttggtttatttttatggaattatttgtttgattatgttggttttgtctttaatgatttttaaaaatactgatattgttcacattcatcagcttactgatgataagctagatggttattatcaggttttgtatcccaaaatttatccataggtgtgggtgttgtggtatttggattgtggcactgccctagcaggggcggaggtagagtatcaagacaaacaagtgatcatcgaacgataattttgctttaaatcccaaggacaaccattattaggatctcgtaattgggcaatgatacgaataaaatcttgaatgtggtagttcataaataatctcatgaaataaatagtatttgaaataaggatatcatagccttgaatgaacaaaaaaatgaaaaattttttaaaacgtgatctggtgcaaatttttttatttttatcaatgctagtatagttccaacagttagttaaattcattaagctaaggaggcaattatgtataaacacgtattagtggctgtagatctttcagatgaaagtggatttttactcgaaaaggcagcaaaaatagcgaaacaatatggtgctaaattatcggttatccatgttgatgtgaatttttcagatctttatacgggtttaattgatgttaatatgtcttcaatccaagatagaatttcaactgaaacacatcaagccttgattgagttatcagaacaatctacctatcctgtttctgagaaattgagtggtagtggtgatttaggacaagtcttatctgatgctgttgagcaatatcaggttgatttattagtaacaggtcatcatcaagatttttggagtaagttaatgtcttccactcgccaagtgatgaattcaattaaagttgatatgttagttgtaccgcttagagaagaataaatataaagaatttgtgatgggcagcgtgagttgcccttttttattagcattgaaatattgttttgcataatgcgttattacttcttgagagaatatgaataatcagctaaaaaagttttttataaatgtcaaaaatatgcaacaataagcaggttttttactggatttacaagatataacaaggttttttaatgaaaacaacagcagaaattagacaggcttttttggattttttccatagcaagggacatcaaattgtagatagcagctctcttgtaccggaaaatgatccaacgttactttttactaatgcgggaatgaatcaatttaaggatgtttttcttggattggatacccgttcttatacgagagcaactacagcacagcgttgtgtacgtgcaggcggtaaacataatgacttagaaaatgtcggttataccgctcgtcatcatactttttttgaaatgcttggtaattttagttttggagattatttcaaacaagatgctattaaatttgcttgggaatttttaacttcaccagaatggctcggattaccaaaagaaaaactatatgttactgtttatgaaactgatgatgaggcctatggtatttggcataaaggagttggtgtgccggaaaatcatattattcgcattggtgataataaaggtgccccttatgcttctgataacttttgggcgatgggtgatacaggaccttgcggtccttgcactgaaattttttacgatcatggtgagcatgtgtggggcggtttaccaggtagtgaggaagaagatggtgatcgttatattgaggtttggaatattgtatttatgcaattcaatcgattggctgacggcacgatggaaaaattaccaaaaccttccgttgatacggggatggggttagaacgcattagtgcggtaatacagcatgtaaattcaaactatgatattgatattttccaaaaattaattgctaaggttgcagaactgacaggggaaaaagatttaactaacaaatcgttgcgtgttatagctgatcatattcgttcttgtgcctatttaattgcagatggcgttattccttctaatgaaggacgtggatatgttttacgtcgcattatccgtcgtgcggttcgtcacgggcatttattaggtgctaaagacactttcttttataagctcgtaccggttttgatcgatgttatggctacagctggtagagatgtaaaagcgaagcaagccaatgtagagaaactgctacgattagaggaagagcaatttgctcgtactttagaacgtggtttagccttgttagatgaggctttaattagcgtaaaagatggtgtgttatccggtgaagtagcatttaaattatatgatacttacggttttccattagatttaactgccgatgtttgccgtgagcgtaatattcgtattgatgaggaaggcttcgagcgtgaaatggaagtgcaacgcttgcgtgcacaggcggcaagccgatttggtgtagattacaataatgttattcgtgtagaagggacaactacttttgaaggttatactgaggctgaaactcaggcaaaagttaccgcacttttctatgaaggcaaatccgttgagagtattagtgcagggcaaagtgcggttgttattttagatgatacaccgttttatgctgagtccggcggacaaataggtgatagaggttgcctgattgcgacaaatatgcggtttgacgtgaaagatacgcaaaaatatgggcaagtttttggtcatatcggtacgttaattcaaggcacattaaacgttggtcaaacaatcaatgctgttgttgatacggaacatcgtacaaaaacttcattaaatcatagtgctacacatttattacatgcggctttacgtcaagtattaggtactcatgttgcacaaaaaggctctctcgtatcagatactatattacgttttgactttgctcaacctgaagcaattagccaagaacaattgtttgaaattgaatgcctcgtaaatcagcatattcgagctaatcatttggtagtaaccgaagttatgcctattgatgaagcgaaagctaagggggctatggcattatttggtgaaaaatatggtgatgtagtgcgtgttgtgaaaatgggcgagttttctattgagctttgtggcggtattcatgtaaaacgtacgggtgaaattggtctatttaagattgtttccgaatctgctattgcggccggagttcgacgtgttgaggcagtaactggagaggttgcaattaattggttgcaacaacagcaacagatcttaatgcaaagtgcggatcttttgaagtctgatgcaaattcattagtcgaaaaaattcagcaattacaagataaagcgaagaaaacagaaaaagagttgcaagcactaaaagaaaaatctgcgatgaaggcgggttctgatattgctaaaagtgcggtagaaattaatggtgtttctgttattgttcaacagcttgaaaatatggatgtaaaatctttacgtgttattgtcgatgatttgaaaaatcagttgggatcagcggtaattgcttttgttacgaagaacgaagataaggttaatctagttgttggcgtgacaacggatttaacctctaaagttaaagcaggcgaattagttaatttaatggcacagcaagtgggtggtaaaggtggcggacgtcctgatatggcaatggcgggtggatcacagccggaaaatatctccaaggcgttaacagtttgtaacgaatggttacataaaaatttataaaataaaaattttgtgttgtggctcacatttttgaatattattcatctctttgtgggaataaataacgtacaatgtaagtcggataacacttcattattatcatgctttattattataacgctttgttatttaaggattttaagcaagatagagatcttataaattcaactgaaatgagagggttatatgctgatattgaccagaaaagttggcgagagcttactcattggcgacgatatttctatcacaatattaaatatacgtggcaatcaagtaaaaatcggtgttgaagcaccgaaagaggtttctgttcatagagaagaaatttatcatcgtattagagatgttaaagatgaacagcagttgtaattggctttttgaacgataagatatggagaaattatgagtaaactaacttgttttaaagcatatgatattcgaggtcgtttgggtgatgaattgaacgtggatattgtatatcgtattggtcgtgcatttggacaatttttaaaacccaaaacgattgttgtcggtggtgatgttcgtttaacaagtaaagaattaaaaagtgctgtaacaaatggtcttttggactcaggtgttaatgttattgatttgggagagacgggcactgaagaggtctattttgcgacttcattcttaaaagctgatggtggtattgaagtaacagccagtcataatcctatggattacaatggattgaaacttgtacgtgaaggttcgcgtccgattagtgcagatacaggtcttgcagatattcaacgtcttgcggaagaaaataattttgctccagtttcccaacgtggggagtataaacaactttcagtattagggcattatattgagcatctcttatcttacattaatttggaaaatttaaagccaatgaaattggtgattaattcaggcaatggtgcagcaggtcatgttattgatgctattgaagcacaattccgagctaagcatgtgcctgttgaatttgtgaaagttcacaataatccggatggtactttcccgaatggaattcctaatccgattctgcatgaaaaccgtcaagatacgattgatgccgtgttagagcataaagctgatatggggattgcttttgatggcgactttgaccgctgtttcctatttgatgaagagggcggttttattgaaggttattatattgtgggattattggcacaagcatttttacagaaaaataaaggggctaagataatttatgatccacgcttaatttggaatacgattaagttagttgaagataatggcggcgaagcggttatgtctaaatccggacattctttcatcaaagaaaaaatgcgtgctgttgatgctatctatgggggcgaaatgagtgcacaccattatttccgtgattttttctattgtgatagcggaatgattccttggttgcttgttatggagttagtgtcaaccacaggtaaatcactaggtgagttagttgggaatagtcttgaaacctatccatcaccgggtgaaattaacagtaagttagttgatgcgaagtctgcaatagagcgtgtgcgtgttgcttatgaaaaagaggcagtcagtgtagatgaaactgatggtatcagcattgagtatccaaattggcgttttaatttacgcagttcaaatacggagccggttgttcgtttgaatttagaaacacgaggcgataaacaattgatgacagaaaaaacagaagaaattctcgctttattgcgtcaataaattaaacttaagtaagaccgcactttgtttccgcaaagtgcggttatttatggctctaattaaggaaattaaaatgaaagtaattattcctgttgctggcttaggaacgcgtatgttgcctgcaactaaagcaattcccaaggaaatgttaacgttggttgacaaaccgttaattcagtatgtcgttaatgaatgtgttaatgcagggattaaagagattgtgctggtaacgcattcttccaaaaatgccatagaaaatcattttgatacatcttttgagttagaaacaatgttggaacagcgtgttaaacgccagcttttagatgaagttcgttctatttgtccgacaggcgttactattatgcatgttcgtcaagggaatgctaagggactagggcatgctgtactttgcggtcgggcaattgttggcaaggaagcttttgccgttgttttacctgatgtattacttgctgaatttgatagtaatcaaaaaacagaaaatcttgctgcaatgctgaagcgttttaaagaaacgggaaatagtcagataatggtttcacctgtacctgataaagatattagcagttatggtattgttgattgtggcggtgttactttaaatattggtgagagtgttaaaatctcaaatattattgagaaaccctcatttgaggacgcaccttccaatttgtctgttgttgggcgttatgttttttcagcgacaatttgggatctattggaaaaaacgccagttggtgtcggtaatgaaatccaattgactgatgctatcggtatgctaattgaaaaagaaattgttgaagcatttcatatgaccggcaaggcttttgattgtggagataaaataggatatatgcaagcttttgtggaatatggtttacaacactctcaattaggggagaattttaaaacctatttgaaacaactggtgcaggacttgtagaaattcgttatggctaaactttgtcggttctttaatataaaattttattaagggaccgattttttgtgattaaaaactgctatcaattcatttactttaattcttttgtgagatgatttgctaatagaacgctgaacttttaagcgtttaatttttgcgtctttgtagatctctctagtaaatttggtatcgtggttagagattaagaccggtacatcgtggtttagtgcggtatcttttgccagttgagctaaattttgttgatgagataaagaaaattcattgcctgagtagctggtaaagtttgagttttgtttcaatggtgcataaggtggatcacaataaataacagaatcattattgatcattgaaaatgcttgttggaaatcagcacaaataaacaccgctctttgtgctttttgggcaaaataacgtagttcagactccggaaaataatgtgttttataactaccgaatggaacattaaattcatttttagcattatatctgcataatccgttgaaaccatatctatttaagtacaaaaacaaaaccgcacgttcaaaaatattttgcgataaattaaattcagctctgcgatggtaataataattagcggtattagcttgatcatggaaaaatattggtttgcatgccgcaatataatgttcaacatcttgttttacaatattaaatagatggatcaagtcagggttaatatctacgagaatatagtgttcaaaatgagtatttaagaatacagaaccagcaccgacgaaaggctcaataaggcaagttttatttttaggtaaaagtttgttaatttcctctgttaagcgaaacttaccgcctgcccattttaaaaatgggcgatatttcactaaattagaagaagttcctttgctggacatgaaagattaacttttttttgaacaggtacgaattgcatcaagcacgtattctttgtccgtatctgttgcaacgtaggcttgaccaagtgattttagtaagactaggcgtaattttccagcaagaacctttttatcacgcatcatatgtggtagataatcttcagctttcattgtatcaggtgaggctgtaggtaaatctgcttgagttaaaagtttctccagtctcgttacatcgttaagtgataaatcacctaattgattagacaagacggcagctatcatcattccggttgcgactgcttctccatgcaaccaatttccatatccaaggtgagtttcgatagcatgcccgaaagtatgacctaaatttaataacgcacgctctcctttttcagtttcatcacgagtaaccacatctgctttaatttgacaacagcgagcaatgcactgctgtaaatattgttgttctaaagcaactaaattagttatatgtttttctagccatgtaaaaaattcatcatctaaaatagcaccatatttaatgacttcagctaaacctgcgtgaatttcccttttaggtaaagtagttagcgttagcgtatcaataataacggcacaaggttgataaaaagcaccgatcatgttttttcctaatttgtgattgacagccgtttttcccccaacggaagaatctacttgagcaagtaatgtggttggaatttgaataaaacggacaccacgttgatagcttgccgctgcatatccggcaatatcaccgatcacaccgccacccagtgcaataatagaggtatctcgtccatgattagcttttaaaagtgcggtaaaaattaagtctagagattctaaagttttgtattgttcaccttctgggagttgcacattctctaccgagcaaccaattttttctaaggtgtctgttacagaggataaataatactgtgcaattgtagggttagttacaatcatcaccttatcgcctttttttagcggataaacttgtggttcggataataaccccattccgatatggataggataactacgttcccttagttctacattcacacacagcattttatacctcaaaatgtaattagattttaatattatcaattaaatcaatgatttgattcgccattaatttggcactttgctcgtctgtcggcaaaataatatcagccacttcttcatataaagggttgcggactttggctaaatcttctaatacttggcgaggatcttcaacattttgtagtaatggacgttttttatcacgttgagtacgttggaattgtttttcaacggtcgtttctaaataaataacggtgccacgagcagataaataattacgattatcttttgatacgattgcaccaccaccagtagaaagcacaatgccttgtttttgagttagttcattgatgatacgttcttcgcgtttacgaaaaccttcttcaccctcaacgtcaaaaatccagctaatatctgcacctgcacgttgttcaatttcggcatcagtatcaataaattccatgcctaaaatttgtgctaattgacgaccgattgtactttttccagcccccataggacccactaaaaaaatattacgtttttctgccatttgtacttcttctttacaaataaaattaaaaaattgatcttataaaaaacaaacgacctaaaataaagaggtcgtaaaagatcgcccaaaaataatggagattatctcaataaatgcccccttttttcaacctaaaaggggatttattttaagatttcattaagtgcggtttattttaatactattttaatggttttattatttcatcaggttgttctgaacgaatgatccttggggtaacaaaaattactaattcacgtttttggtgtctttcactttcacggctgaacagtctttttaatataggtatatctcctaacaacggtactttatctactccttttgtgattgtatcgtgaaatacgccacccaacacaatcgtttccccatctcgtgcaaaaacttgagtattaatttcttgtttatcaatagataccatttcattttgcccataagtaatacgacttccaggggagttttggcttacaatgagatccagtaaaatagtattgtctttagaaatgtgtggcgttacttctaatcctaaaactgcttctctaaactctactttctgttcatcagatttcttgccggtaataacataaggaatttcagttccttgtttaatacttgcactttgcttattcgttgtaagtaaacgagggcttgcaataatttccacattattttctcgttcaagtgcggtaagttctaagtctaaaagtcgatcattaattttggcaatttgtaaagcaatagaacctgcaggtgttgcggtagtagcaaaattgacgttaagttgttccgttaaatgctgaaatccgtttgctgctagattgcctgaaagatgatgagcgttatttgtaggctcaaaaattccccaacgaacccccaattcttttaaattttcatcgctaattgttacaattctcgcttcaattgcaatttgttcaataggttgatccatttctttgattaatttttttaaggcattgagagtttcctgattatcctgaattaagagcaagttacttcgttcatcaaaactaaaagttccatttgatgaaagccatgaaccttgacctgtagtcagtgatttcattacatcagccgctttagcataatgtaatttgatcgaagtcgtcgttaaatttggctcattagtcgattttgacaaattttcctttgtatctaattgtatatttgtctctttttttatgcttctttgtcttttatcaaagggatctctagcagataattccacacttactgtgaataagaacaaaaagaaatataagaaatttttaattaacataggtattctccatgactaaagttgtaaagaaatatcggcttgaatggaaaaatcttcattttcactatgagaaatttgcaacgaaactaaattgagtggaacttgaggtaaaagtgcggttaaaaattgagataaatcggaaaaatagcctttaacgtgaaaagttaaaataggttgatttcccatttgccaatgagattgttcaaataataattttccattatttaacaattgtaatttttgattaatttgtgcaagaggtttattaaactcaatattattttgttgatagcgttcctttaagctggttaatatttgttgcctgtgaacaagtcgagcatttttttcgtcaatttcaacttgaagtttgtgtgcaatttcttgttgctgaatataattgagcgagggataaattgagcttatcaaaattattaagaaaaaaattaaaatttgttttagtgaagataaatttacccattttactaacaaattatcagaatgctgtaacttcatgatctattccttatgttgagttaaacttaattcaaattcaaatatgactgatcttctctgatcaatttgttgttctttaaatgtcaacagttttacacttgaaaacaaattttgttgtttcaagaatttttgtagctgttcaacttcattatttttctccgtttcaccttgcaaaattaatttttcaaaatctaaggacagctcgtttaattccccactttgtaacggaagtttagaaattgttgttaatattgataaaaattgttcattcggtaatttttttaagttttttgatttaccgccataatttctttgtaatgtagaaatgttctgttttatttctgcaagtttattgtcaatttgttgtatttgctctctttttttatctatttcggtgtcaattttttgagttaaataaagtataaaagtcacaccagcaagacagataatgaggctggcaagtgatttataaataaacgattttattttttgtcgataaatttcttgtcgccaaggtaataaattaatttcaatattacgcatttattattcctttaattccgttatttgatagagttcatgtcttccccaaagagcatttcctaaagcaataaaaggcaattcggtattaatgatgttccatttatgagtgatattttgttgttcatttttttcacaatagcaccaaacgtgttgaggttggcagttaaaacgttggcagaattcttgataaagtgcggtaatatttttgtcatttttttgtagaacgattgtttgttgtccgatttcttgtattgctatacagccgttacgatcctgatataaatataatgtttccatcttttctttttgggggtgaaaataatggaatgctcgtagtaggctattacttaagcaatctaacgtattaatttttatagggaaaaaacgatgcacataattttgagctgtttgttttctaacaacgtagatagccagttttgcaccttgtgttaattctttatattggtagtcgtaccaaatatcaccgaaatctgtcggcaattcattttctatgattaagttacattgttgttggcattcttgctcatttaacttttgcgtcaatatgattgtttttacccagacgtgctgattgggtaaacaggctatccatgtgcagatattctttgcgaattgtggtgtcaaatcagatagtttaagagggggattatcgtttttagttaaaaagtgcggttgtttttgttcatcaaaccagaggaattgccattgttcatcttgtctatgaataccaatttgtaaaatatttgctgtttttttgttaggtctcatttcatattctctttaataaaatttatattttaaaacttagctttattagctaaatcctttatacttacctcattgattatcgatatatttttttcaaatacattaaataagagagaattttacgatgaggatcgcaaaattaatatttagtaccttactaacgttgattattttagggtgtgttgtagtcggtattttttacattcagataaagaaagatttgcccagtgttgatggtttaaaaacagttgagttacaacaacccatgcaaatttatactgctgatggaaaattgattggtgaagtaggggagcagcggcgtattccagttaaattgcaggatattccacaaaaattaattgaggctgtattggccacggaagataatcgtttttatgaacatcatggattagatcctattggtattgctcgagctattagtgtagctatcagcaaaggaaatgcttctcagggagcaagcacgatcactcagcaattagcacgcaattttttcttaacaccggaaaaaaatcttgtccgtaaaattaaagaggcaattttagccattgaaattgagcatgttttaactaaggatgaaattttagagctttacttaaataaaatttatttcggttaccgtgcttatggcgttgcggtagcggcaaaaacctatttcggtaaagaattatcgcagttaactttatctgaaatggctgtcattgccggattgcctaaagcaccttcaacaatgaatccaatcagttcattaaaacgtgcacaggatagacgtaatgttgtattggggcgtatgcttgagacgaactatatttctaaagctgaatatgatgcggcgataagcgaacctattgttgcctcttatcatggaacacagttagaatttcgagctgattatgtgagtgaaatggtccgtcaagaaatggtaagacgctttggcgaagaacaggcttatacgaaaggatataaggtattcacaacaattttatccaaagatcaggcacaagcacagaaggctttacgtgagaaccttattgcttatgacatacgacatggttatcgtggtgcggtcactttatggaagaaaaatgaaaaggcttgggaaacagaggcgattgtagcacatctaaaatctttaccaaattccaatccatttattcctgctgctgttctgtccataagtaaaacgggagctaacttgttgttagcggatggtaagaatattactttatctaacaatgcgatgcgttgggcgggtaaaaaaatgcctaaagaaggtgatcaaatttgggtaagacagcagaataaagaatgggttttagggcaaattccggaagctaattctgcattagtttctcttaatagtgataatggggctattgaagcgttagttggcggttttagttttgagcaaagtaaatttaatcgtgccacacaatccttggtgcaagttggctcatccattaaacctttcatttacgctgctgccttggagaaaggattaactttatcaagtgttttattggattcggaaattgttattcaaaaaccggggcaagaaccttggacacctaaaaattcaccaaatcgatatgatggtccaactcgattacgtgtaggattaggattatcaaaaaatatgatcgctattcgtgcgatccaaatggcaggtgttgatttcagtgccgagtttttgcaacgttttggttttaagtcggaaaatatttttgccagtgaagcgatggcattaggtgcagcctcttttactccgttggagatggcaagggcttacgcagtatttgataatggcggttttttagttgatccgtatttaattgaaaaaattcaagataatatggggaatgatgtatttattgcgaaccctaaaatagcttgtatcacttgtcatgatattccggtaatttatggagaaacagagaaattagacggatttaaagagaatacatctatatcggataatgccaatgccttagatttagggggggaggaagtcagtgaaattactgatatacccgaattaaatacggttaataaaaaattagatgaaagtgcggttctctttatggctgaggcgaagacggagcattcgacggaacaatatgcacctcgtgtgatcagtggtgaattggcttttcttattcgtagtgcattaaccagtgcggtctttggtgaagaaggacttgattggaaaggaaccagttggcgaatggcagagcacttcaagcgtcgtgatattggcggaaaaacgggtacaaccaataattctaaggttgcatggtatgcgggatttggtgcaaatctagccactgtggtatatgtcggatttgatgataataaaaggagtttaggaagaggagaaacaggctcggcaacagctatgcctgcatggatttcctatatgaaattcagtttaaacgatattccggaaagaaaacttgccttaccgccaaatatagtggaaaaaaatattgatgttagatccggtttattggcagaaacgggagaagggaaaatagaatactttattagaggtacggaacctaaaagaacattcgttcaacaaggacgtggttactaccttccttctgaaacggatctgccaagtgcggaaccggaagaaattttctaaaacaaaccgcactttgtaaaagtgcggtctatctttcattattttataaggctaagtttatgctaagttatcgtcacagttttcacgcaggtaatcatgctgacgtgttgaaacatattgttttaatgttgattattgaaaatttaaaattaaaagaaaaaggattttattatttagatacacactctggtgtcgggcgttatcgtttattcggtgatgaagcggaaaaaacagcggaatatcgagaggggattgctcgactttgggcaaaagaggatttacccgaggtaattcaacgttatatttctttaattaaaaagctgaattacggtggtaaagaattacgttattatgcaggttcgcccctgattgccgcacaacttttacgctcacaagatcgtgcattgttaacggagttacatccggcagattatcctttgttacgcaatgaatttaaggaaatcaataacattaatacaaagcgggataacggttttcagcagttgaaagcgactttaccgcctaaagaacgtcgaggtttgatcttaattgatccaccttatgaactaaaagaagattatgatcttgtggtaaaagcaattgaagagggatataaacgttttgcaactggtatttacgccctttggtatcctgttgtattacgacaacaaactaaacgaatcatcaagggcttggaaaatagcgacattcgtaaaattttgcagattgaattagcggtacgtccggactccgaacaacgaggaatgactgcaagtggcatgattgtgattaatccgccatggacattagaagatcaaatgaaaaaaatcttgccttatttgacccgcactttagtaccagaaggaaccggtaattggtctgtaaaatggattacgccggaatagaaaataccaatcaaattaatttattcaggcatttggtttttttggcaaatttttagcagaatacataaacttaaatataggagagaaaaatgactaaacattatgattatattgctattggtggtggtagtggcggtattgcttcaattaaccgtgctgcaagttatggtaaaaaatgtgcaattattgaagcaaaatatttgggcggtacttgtgtgaatgtcgggtgtgtgccgaaaaaagtcatgttttatggtgcacaagttgctgaagctattacaaaatatgcacctgattatggttttgatgttacgttaaatcattttgattttgccaaattggttgaaagtcgtcaggcttatatcgatcgtattcatacttcgtacaacaatgtgcttgcaaagaataatgttgatgtattaagtggatttgctaaattttttgatgcaaaaaccattgaagtgagttatgcaaacggcgaaaaagagctggttacagcggatcatattttaattgctaccggaggacgtccgagtcgtccgacaattccaggagcagaatatggtattgattctgatggtttttttgcgttgaccgaattaccaaaacgtattgcggtagttggtgcgggttacattgccgttgaattggcgggcgttgttaatagtttaggtgcggaaactcatttatttgttcgtcggcaaacgccaattcgtagctttgatccgctgattattgaaactcttgtcgaagtaatgaaacaagatggtattcaattacatacgcaagctattccacaagaaattatcaaaaatgcggataattctctaacaattaaattagaagatgggagaacgcaggacgtagattgtttaatttgggcaatcggtcgggaacctgccactgatgtgattaatttggcttcaaccggtgtagaaactaacgaacgtggatttatcaaggtagataaatatcaaaatacgaatgttgaaggtatttatgccgtcggtgatattattgagggaggaattgaattaacgccggttgcggttgcggcaggtcgtcgcttatctgagcgtttatttaataataaaccggatgagcatttagattaccatcttgttccgacggtagtatttagtcatccaacgataggaactgttggtttgactgagcctaaagctattgaacaatacggtgcggaagcagtgaaagtttatacatcttcttttacaccaatgtatagtgcggtgacttcacaccgtcagccttgccgtatgaagctggtttgtgttggtaaagaagaaaaaattgtcggtttacacgctataggttttggtgtcgatgagatgattcaaggttttgccgtagcgattaaaatgggggcaactaaagcggactttgataatactgtcgctattcacccgacaggctcggaagaatttgtcactatgcgttgataaaagtgcggtattaattaatgaaaaaaggattgttctctaccttagaggtcaatccttttaatagcgtatcttgatttagaaagatattctcgacctttcaaatgattagacataaaaaaaataactgttatactgatcaacgagtggagaattcggtttatcttcaatctatctcctataattagtataagaaggaaaagaaaatggcaaaaggacaatcactacaagatccttatttaaacgcattacgtcgtgaacgtattcctgtatcaatctacttagttaatggcatcaaacttcagggtcaaatcgaatctttcgaccaatttgttattttattgaaaaatacagttaaccaaatggtgtataaacacgcaatttcaacagtcgttccggctcgttcagtttctcatcataatagtgttcagcatcaccatattgttcaaactcaagaaatgcaagcggaagcattagctgaaaatcaaactgaataattttgaatacaaacaagcaattcaaagtatataccgcaagtgcggttgattttgcccaagatcctaccgcactttcttccaacataaatgtgcctcaatttgacaaagcaattgtggttcatgttttcttttctcaaaataaaaatctagaggatttacaggaattccaacttttggttaaatcagcaaatgttgatattctttcaataatcacaacctcacgctccacgccacaagctaaatattttgttggacaagggaaggcagaggaaattgctcaagctgttgaacaactcaatgcggatattgtgttagttaatcatagcttaacacctgcacagactcgtaatttagaaagtatctgtcaatgtcgtgttgtcgatagaacaggattgattttagatatttttgctcaaagagcgaggtcgcatgaaggaaaattacaagttgaattagcacaactcagacaccttgcaactcgtttagtccgccgaaaaacaggattagatcaacaaaaaggtgcggttggattgcgtgggccgggtgaaacacaattggaaacagatcgccgtttaatcaaagttcgcattactcaattacaaaatcgcttagaaaaagtagcaaaacacagaaatcaaaatcgtcaaactcgccgaaaagctgatattccgacaatttcccttgtcggttatacgaatgcaggaaaatccactctatttaatgtgctaactcaagctaatgtttatgtggcagatcaattatttgcaactctagatcccactttaaaacgtttaccaattcaagatgtagggaactgtgttcttgctgatactgttggatttattcgtgagttgcctcatgacttggtttctgcgtttaaatcaacattacaagaaactactgaagcaagtttattgcttcatgttattgatgtcgcagatagccgtaaattagaaaatatgttgacggttaatgaagttttaagtgagattaaagcaaaccaagttacaacacttttagtgtataacaaaattgatcaagtcgagaatattcaacctcatattgaatttgatgaagaaaatcaaccgattgctgtttatctttctgcacaattaaatcaaggtttggatttattagttgaggctattcgacaaaaattaagccacgaaattctacatttagagatcaatcttgctgcacaatacggtaaaattcggcattgtttttatcagcttaattgtgttcggcaagagaaaatcaatgaacaaggtgaattcttacttgatgttcaaattgataaaattgaatggcttaaattaagtaagcaatttccgctattgaaacgtttttatgaatcaacagaaatcagcgacaaataaaccgcactttttaagtctatttgacaattccgtattgttttaatttattggcaatggctgtatgcgacatccctaaacgggctgccaacttacggctacttggatattgctcataaaatttttgtaacaccattgactcgaacttattcattatttgttctaaggtttcaccggcaaattgatcaacattaaccggcaaaatttcttgctctgataagtttaaatcagcaattgccaactcattatttttggctaatgagcaagctcgatataaggcattatataattcacgcacatttccagcccaagtataatttttcagatattgaataaaccgctcattaaagtgcggtactgaaatagaaagtttttcactaatttgacgaataaatatttctgtgagaggctcaatatcttctactctttcacgcaacggtggaatagtcaaacttaaaacatttagacgatgaaacaaatcttcacgcattttaccttgttcaacatagtgttgtagcggaatttgcgatgtgcaaattactcttacatttgcacaatgttctttttcctcgccaacacgacgaaaagtaccatcgtttaaaaaacgcaacagttttgcttgtagctctaaagaaagttcagcaataccatctaataataccgtccctctattggcatattcaaaaaagcctgttgtttcaattcccttatccaaacgaccgaacatttcactttctgcatcttcagcaggtagccccgcacaatttatggcaataaacaagtgatccttacgaggaccggcattatgactggcttttgcaattaagtctttccctgttccggtttctccttgaatgagtaaaggtgcgtccaatccggcaaaagcttttgctgtttcaattaacgtctgcatttttacacttttacatacaatatcatcaaaagaaatcagctttgtcataatttaccccatttaaaatcaattgattttgtattctaaacgttgaacaaaaaatgtaaagaaaaatgaacaccaaagataaaaatgtttactcttgatctacatcacaaaaccgaacatttacaggttcagtcagttccaacactactactaaagtgttaaaatctcctcaaatttttaaattcactttaatagcgaggtataaaatggcatttcgtatcgaaaaagacactatgggcgaagttcaagttcctgctgataaatattgggctgcacaaacagaacgttctcgtaacaatttcaaaatcggtcctgaagcttcgatgccaaaagaaattattgaggctttcggttatttaaaaaaagccgccgcttatgcaaaccatgatttaggtgtgttaaatacggaaaaacgtgatttaatcgctcaggcttgcgatgaaattcttgccaataaacttgatgaccaattccctcttgtaatttggcaaactggttcaggcactcaatcgaatatgaatgtcaatgaagttgttgcaaaccgtgcacatgtcattcaaggcggtaaattaggagaaaaatccgttattcacccgaatgatgatgtcaataaatcccaatcttcaaatgatacttatcctaccgccatgcatattgccgcttataaaaaagtggttgaacatacgttaccttgtgtcagacgtttgcaaaaaacgttagcagaaaaagcagaattatttaaagatgttgtaaaaattggtcgtactcatttaatggacgctacaccattaactttaggtcaagagttttcggcgtatgcggcacaacttgctttcggtatcaaggcactggaaaacaccttaccgcatttgcgtgagcttgccttaggtggcacagctgttggtacagggctaaatacacctaaaggctatgatgtaaaagtagcggaatatattgctaaatttacagggttaccttttgttaccgcacaaaataaatttgaagctcttgcaactcatgatgcgattgttgaaactcatggtgccttaaaacagttagcagtttctctttataaaatcgccaatgatgttcgtttattggcttcaggtccacgctcaggcattggggaaattctcattcctgaaaatgagccgggttcatcaattatgccgggtaaagtaaacccaacgcaatgtgaagcaatgacaatggtttgtgcacaagtactaggtaatgatgtcactatttctttcgcaggtacacaaggtcatttccaattaaatgtgtataaacccgtcatggcatacaatttcttacaatcggcacaattattaggtgatgcttgtgtgtcatttgatgaacattgtgcaatgggtattgagccaaactatccacgtattaagcaacaactggagcaatctttaatgttagttaccgcacttaatacgcatattggttatgaaaatgcagctaaaattgcgaaaactgcacataaaaatggtacaacattgaaagaagaagccatcaatcttgggttggtgagtgcggaacaattcgatgaatgggtacgtccggaagatatggttggcagcttaaaatagttcacttattgaacatttaattaaggcgagatgagttctcgccttattttttactacaatagctttaacttaacattattttttataactgaattggttccaattttgatttttgttccgtagttaaaacatctgttgaaataatatgtaatccggttttgttattcagtcccaaatcagcatggaaataatcaggtaatttgtacattgcacctgttataggatcaacaataagtaacccaattaagcctccaaatacaaagtttccaatataccaaccatcaagtttcgcttctaacagaaaagtttggcttttggcatttttaccttcaggggtaaaagtaatttcatatttttcgcctttgaaatatccggctcctgctggtaagacaacattttgaggtgtttttccggatgtaataacttttccagctctattttttatcacaaagtaggcattactagggtttgattgaattgaaacattataatcgcgtttactcacgatagttgcacaaccggtagcaaacatagcgacaaatgctaatactgataattttcttaatcttttcatggataaatcctcttaaatgtgtaaaatggtaacaattatactaatctgtctattagtgttcgaagttagattttaggtaacaatctatattttgactagaaacgaataagataaattactacctaaattgtgattaaaattacccaatttgtgaggttctcatggcaatgcataataaaattcgcctgatgcgggaagtccgccaatggtctcaagaagaaatggctcataaaatgaatatgtctctaagtggttatgcaaaaattgaacggggcgaaacaaagttgcactatgataaattggttcagattgctcgtatttttaatatgaacttagcggatctgatagatattgataaaggtgtaattttttgtatgaatgagaacagtgattatatttatacaaattatggcaatatgagtgaatcatcgttaattgaaatcgaaaaattaaaactgacgcttgcacataaaaatgagttgcttattcaaaaagaaaaagaaattcaatcacttaaaaagattattaccctgttggaaacttcaaaataaggcatttctctgatgtgtcgttgattggcaagaacaccactttaaaaattacctgttggcgaaatgatatatgttttaattactttgctggatcataatattccgttatgtgttcttttagtgagccggttgtccgaaaaaattcattggctgataaaatagcttaaattttccagcatttcattaattatttaaccttttatctgtttgtctttccctttaaaagtgtcttattttatcaatcatctttgtgaaatttttgagaaaaatttgaaatgatatcaaatgcttctgtaatcattcgcctgttgtaataattgccgactttctttcaaaaattgctctgaatactcaccaaaccattcccgcacttgattaaaacagtctataaacccctgcttgttattatgttcaaagaaatttagactttcttcatagctttgttttagactcttaatcacttccaaattctccgatttgtccataataatatctgcataaagttccgcatcttgagcaaataaacgtccgatcatggctaattcaagacgataaatgggtgaagatagggcaagcaattgtgccaactcaataggttgttttgataaatgcaaaccatttgcaaaggttgaaaaatgacgtaaggcttgtacatacgtcatacttttatcatgttcggttgcatcaacttgataaattttcgctccccacatttgaatttgttccaaaaaccattggtatttttcagggtagcgaccgtcacaacgtactaccacttgctttgccatattggtaatatccggaccaaacattggatgtaatcctaatactgcaccttgatgcacttgtaacattttttccaacggttgacgtttgactgatgttaaatctgttaatagcatattttcggttagataaggctttagacggtcaatcacatttaaagtttgtgcaattgggacacaaacaataactacatttgcattttgtaaaattttatccgcactttgccaatcctgtttctctaagacagcaatttgataaccggaagaagacaaataacgagcaaataatgcccctaattttccctttcctccaacaatgacgattttttttatttcaggatttgctgttttaaaaccgtattgattttctctagtataagattcccgcatcaaacgacgcaaaacatcttcaattaaatccggtgaaacacctaacttttccgcttcattgcgacgagcctgtaacatttcattttcacgttcaggtacataaatcggtaatccatattgatgtttcactttgcctacttttctgactaattctaagcgttgagaaaaaaggtgtagtaattcacgatctaagcaatcaatttctgttcttaaattttttaaaacgtccatagctattttcatcttactaatatagtttgtacatttattattacaatggttgtaaaaaataacttacaaaataaatatcaaatacgcaactaaattttataaaaaaataccgcactttgcgttctgattaatccgcaatcgtttgcttgtgtaatttatattatgctattcttagcattatttttagtaaaggaattcttatgcaagataataaacctcaaatagccattgtcatgggatcaaaaagtgactggtcgactatgcaagaaaccgctatcattttagatagcttggatttaccttaccatgttgaagttgtatcggcacatcgcactcccgataaactctttgagtttgcagaaaatgcagaagcaaaaggttataaagtgattattgctggtgctggtggtgccgcacatttacccggtatgattgcagcaaaaactatcgtgcctgtattaggtgtgccagtaaaaagctcaacgttaaatggtgtagatagtttatattctattgtgcaaatgcccaaaggcattcctgtgggaaccttggctatcggatctgccggagctgcaaatgccgctttgttagcctcacaaattctcgctgctttcgatccgcacttagcacaaaaattgcaccaatttcgccaagctcaaactgacagtgttttgaataattccgatccgagagaataaggctttaattcttcattaggtaatgttgagcaatgaataaaaagccgatagttaaaacatcctatcggctttatgacttggtcagaaaaattaggctttataatttttattcaaagcaaatgtatatcctctcaaactgttgtttaggactttccggtatccatcctgctatccttagcataagtcatttggtttcccaagccattttaattagttgtcttttgacactactaagagttcaatacctttttctctaattttttctctcatttctaaagacaaaccttcatccgtaataattgtatggattttatttaaaccacacacaatattcgggctttttcttccaaatttgctggaatcggctaaaaccacaatttttttcgctgcatcacacattagagaactcactttatagacctcattaaaagtagttagcccaacgtctaaatcaaagccatcagtaccgataaaaagtatatcaaaggttgaaccgataaaagcagattcagcaaaataaccgtgaaaagaagccgatttttcacgaaatgtcccgccggaaattaataaattataaggtttattcagtactaaaatagcattaaagattgttaaactatttgtcattaaagaaagattatcaaactgctttaagtatgggatcatttgtagcacagtactccctgcatcaaaaatgaccgaatttccttcactaataagcgttgctgctttttgcccaatacgttgcttttgttgaatattaattgctgttttttgtgcaatcggtttatcttctttgtcctctttattgattttttcttctcgttcaagaagttcttcatcaattaagacgacacttccataagtacgtaagacctttctatcttcttcaagtgcggttaaatccttacgaattgttgcacccgtcaatttaaaatgagtagccaaaacatctacttccgttcgcccatattttgctaaaaacgctaaaattagctgtcttctttcaaaaggtttcattgttcctccaatttagcaaaaattggagcgaaccaatctatgctaatatagttttagttttgtcatgacatctaaaagtgaagccattctttcatcggcaattgaaaatttttcattttcataattggaattcaccaaaaatgtagttaaattggctgctttggctgcaattaaaccagtaatactatcttcaataacaatacattcttgtttttcaatccctaatttttttactgctctcaaatagacggcaggatgtggtttgccatattcttcatccattgcactacattgaattgggaagtaatcccacaattttaagcgatcaaaaatggtcttaattacaactggaggcgatgatgtagcaactgccagtttaatatgattagattttaaaaacgctaataattcatacagccctttcaaggctatacctgtttgtgcaattgcattacagccattttccaaaattgcttcacttaatttttggttggatacggataagttaaattttttaatccaagtttcactcaattcatcgatccgtttacccctagtgaatttttcacactctttctcggtaattgcgataccaaattcagccaataccgcaatttgagcctttgcccattgaggttctgaatcaatcattaccccatccatatcaaagataacactattgatttgcatcctttttctccattatcgcatttttcaatgaaaaaatattcaaaatgaaataaaatttacattgttttttgatcttaacaactatatccggaagatattgctacttttaacgcaaattgtgagcgtttatcagttggaaaaattttttccggaataatttgatcaagaggtaagccaatgacgtcaactaacttttgtggtctagcaaaaacagaaaaacctttcatgtgaagactatccacaacttttttctcttcattaaatgccaagacaatcacagattttggattaaaacgaccgctgttacgcccaacagtgatttttcctttcttgcttatttctagaaaagcttggttaaaggctctaatttgtagccagcctagaatagattgcaaaagccacattataattgagaatgtaatcagcaatgtaattggatccatttttacctcttaataaaaagccatagagtctgaataatctggctgtttactcatttagaacatcacttgaccgccagtaatattaattgactgtccagtgcaataagccgcttcttcgctagcatagaattttaaaacattcagtacatcttgataatcacaacctcgctttaaaggtactttatcaatataaacttgctccacttcactctccgagataccaagtttagccgcatattgtggaattaaagattggaacatcggcgatttcaataaattgcctaacattaatgaatgaactgtaatgcctttgtcagcaagatctaatgctaaggattgcgttaagccaacaccgccaaattttgccgcactataaccagaattgtacttacttccgactttacccgatttagagttaatttgaatgatacgccctttaatgccatcacgaatcattaaacgggaaaaatgcttggcagttaaaaagtaacccgttagattcacttttactgataaatcaaaatcatttaaattgaaatcccaaatgggtgaagcttttgcagtacctgcgttatagaccaagacatcagcacgaccaaatacacaatccgttacttttgtcaaagcttcaacgcttgattcatcgcccgcatcaacttgcaccccaattgcatttccttcgccttgcttgacgttaatatcagcagctactttttgtgcattttcgccatttaagtcggcaacaacaatacgatagccggcatccgctaaacctttagataaaaatgcccctagtgtttgaccaccaccgacaacgatggctacttttttttcattattcataatatattcctttaactttcaatttgaaatcatttctaatttggacttaatcacgtttaataactaagatggaactttccattaatgtttttggtggaacaccaacaacatgaacacttcccggaaattccgcttcggtcgccccatcaaaacggaaagtaatgtgtccgagtgcggataaattatccgacgctacactgccaatggcggtaatcggatattcaacaccatcaaattcggcaatatcgccaacttgtaaagcgtcgcttaattcagatggattgtgtaagaaacagtaatcttctaaatcggcaggtgcattttgtttgaaagtgattaacatattgtcgtttagtgcatcatgagcaaaattgccgattttagtaaacgttgttttatagataatcgtcatttgaatattccttttgttttacaagcggttggtttgcaaatttaaccgcttgtaaagtgattactgataaatgaatgcagataccgcccatgcaattaatactgtcggtgcaccagtcaaaaaacgactgactaatacagaaggtacgcccactcgcacagtatcttgtttcgcttctgccattgaaagccccacgggaatgaaatcacaagcggcttgagcattgatggcaaaaagtgccggcagggctaaatgtggtggaatgttccctaaaccgatttgtgtccctactaatacaccgataacttgagcaataacagctccgggacctaagaatggagagagtagtgggaaagaacaaattaacgcaagagtaactaaaccgagtgggctatttgcaagcggtgttaaaccatgagcaattaaatcccccaaaccggaagcaataatgattccaatcaaggcggaaacgaatgccataaacggtaaaatggttttcaggactgtatcaatagtatcacgtccggcttggaaaaagagtgcggcgacagaacccatgcccatacctatttttgccaataaaccattactttgttcggtgatttttttacttgaatcatactgttttgcggtagttgatgaagcaattttttcttcagatatgacagaaagggctgcggcatccacatcaattaacgaaatattattttcttttacggcagaaacataaatatcttcaacaataaattctgctaaaggtcctgatttgccggttgcgtgaatattaatagttggaatgcgacgttttgggtaaagcccacaacgtaatacaccaccacagtcaacaattgcaattccaatttcttctgctggcggttcgccttctttaaaaccatctactgcttcccagccagttaattccaccaatttattcacaatagcaggacgagtgcctccggtcatataaagtatttttttgccttcaataatagataatgttaatggaccaccccaaccaccgttacctttttcaatataaactgctttattactcataatgtattcctctacttttcattccgtttaattagtttagtgagatagattcacttctctatctaatgtaattcccattcttttttcaaagaaagctgtggtaaagtccgtaatccaaccacggaagaagttagtgaacatgccgactaataaatagctaacagctaaaggtccaagaggtaatcctaaagtcgttaaaccactggcaatacctaaataaacgaataattcacctgggttgatatgaggaaataatccgttcattgagtggcagctataagatgctgcggcgtagtaacttggtttataacgctctggtaagaagcgtcctaaacttaacgtcataggattgcaaaaaacgaaagtgccaattaccggtaagatcaaataacgtgaaataggattgcctgcacttttctgtgccagtctttctatacgatcttgcccaataaatttaattaaggcattcattacaaccagtaatgagattaatagaggtaaaataccattcatcattccgactaaggtttctccccctttttggaacaaaccgataaaccattctgctccgtgtgtgattgcttcgatcatacgacctccaattttcaaaataaaacatattttttcatctctgcattttagagacatgtaaatagtaagttattttcattttaaaaactgtgaagttgatcaaaaaatcaaaatttatttcaaaataaattattattgtttcggtttgaaatattgattgagtaatttggacggaaagaggcaccttttgttttaaacacataagaatttaagttaagtaaatgcgaaaaattaagcctttttcatcaagcaattgatgatttattcgtcgcagagacgaataaaagtacactggttttaagtaatggtttggaaatggaaaagggcgataaacccaaaccacctcattatcatcatgtcgtgcatgataaaatgatgcaccaagcagtcaaacaacatttttagttagaaaaacaatgactcacacacgatggagggcggattaaatcagcaactcttttttattgatgatattcaaggttatcgtgctgagaaaaaatcagttttcaggcaatctgaaaatactttttgaataaatggtcatagttgaattggaaaatatcctaaaaattaaagtgatgaatttttcaggatatttttattttaaacttgacatttaaaaaatgtcatgataataaaacgtaaaaagtttattatggtaagaagggaatgaagaaaaaatatataactgcaattctgttattaatatcagcatatgcttattcatataggattaatgttatagatgattatgatttaattgataaggaatatatagaattttggaatagagatgaacttataaaacagatagaagtattaacaatagaattattaaacagaggttatgtaacatcgaaaattattgataaagaagagaatttagttattattcctggaaaaatacaaaaagtaatattacaagataattcgacaaaaaatgcaaaattaaaaaaggaattattaaatttaaataaattagagggagagatattaaatattcgtgatattgatgaaatagtatctaaatttaaaaaaataaaaggtaataatgtaaaaataagggtggaaaatatcaaaggtagtcaagatagtaatataataatcataaatgactttaaacctgcgatatatcctaaaatttctgcagattattctaaaggtattaattcggattcttatcgtggttttaaatatgttgttggatttggtttcgaacaattaataggtatgaatgacgaattaaatgtgaacttttctctattatcagattatagaaatatgagcttgaaatataaaatacctataagaaataatgaagcaacaatacagtatcagtatacgaaagacattttaaatgaagatgtagaaacaatagaaagagaaatattattgaatgtaaatacggatattaataatatagatttaaataattcgataactataaataataaaaggtttaatgtaaggaaaaatacgaatataacaaacaattggttttatgagtttgaaacaagtttagtgtatacaaaattattgaatttaagtggttattatgttcaattaatgttaaaacctaaaataggtataaatattgcggatataagagcatataaaaaaaaggattatgtaattacatcaggtatagattttaatttatattctaaatactatgatttaataacgaatgtgatttataataagaatatgagttcggatagtgtgtatgatcgttatacgagaaaacttaatatatatgggattgataatatcccgttatcaatagcaaagacagataaactcatagttatgaataataaactgaaatatccaatgacaataaacaaaattaatgtaataccatatatcgatgtggcactaggtagtaattttaaagaatattcaactggaatgagcataggttcaaaatttaaatataaacaaacaagtattaatctagaatactcaaggagtaataaaggtaattcagttttaaatttaaatttagggtttgaattttagtgaaaggaaatcttagtgaaaaggagtagttatgtataatgagaaaaaagtattaacaatggtatatttatttgcagtgatatccgctcaagtaaatgcacagaccgtgaaaaatagggacacggaggtagaaaagaaggatggtttcgatataatcaatattaacacgccaaacacaaagggagtttctgttaataacttaaatgaatttaatgttaaagataaagggacagttatcaataacattgagtctactcataaatataagacagttcattttggtgaaatcgatggaaataaaaatataaagactaaagaagcagatatagcagtgttgaatgtgaaggggacgagtaatacaagcttaaattcaactttagaagctgcatcatcaaatccactaaaagtatacatagctaatgaaaatggtataaatgttgatggtggtaaatttgtaaatatcgacaaattggtactgactacaggtgttgttgatgacaatgatatgtcagtgtcggttaaaaaaggtgatgttaatgtttcatcaaaaggaattagcggcgttaaggatatatcgatatatagtgaaaaattagataataaaggtaaaattgctgcagaaaacacaaaaatagtactaggacatagttctataaaaaataatgaaatatcttcattagatgataattatgtgagtgcgagtgatttgggggctatttatgggaatgatatacaaattcagtcgacggggtatacggatattaatgttaacgaattattagcaaaaaataatattaatattaattcaaaaggtaaaattaaaaacaatggagatattatatctggaaataaaatagatataactgctaaatcgcttgaaaataaggggactgtagattttggtaataatacacatgaattaaaatggatagatgctaaaggtaatgtctacactaaagaacaattagaaaaagtgtggaataaaagaatgaaacaaactttaacaccagaatatgcatttctttatttgacgggttctttattaaatcaatgggctactgatgaagaaatggcaaaaaggttaagcccagaggctaatatttttaaaagatttgatgaagctttaaataaatttaatgataaagatacaaatacttttttaattagaaaagataaagaaaaagttaaaaataaacataaacaaagagattttgttaataaaggagatatttatgcaactgagatagatgataaaaaaatattagaagcagttgcagtaagtaatgttaaagccaatcaatctattatttcttcaaaaaacattaaaattaatttgactgatgatttattaaatcaagatgctagtatagaagctattgatgaattagatattaaagctaaagctaaaaaattagttaataaaaatagtttatcaaatgatataacattgaatgatggatatgaaaatttatcttgggatttaatggttttacaaaaagatataagagccaattatgatataatttatgaaaaaggcttggtttctgatcaggcagcaagaaaggctaaaatagctgctgtgaataaatcacaaattaaggctaaaaatatgaaattagatgtagataatatagaacttcacgatgatataaatacaggagcatctattaaagcagataagttagaaacaaattctaaaaaaataagtttaaaaggtcaaagtatagaagctaaagaatataatatgaaaactgatgagcttgttttgaataattcaactatttatacagataatatagatattggtgctaaaaatgttaaacttttaagtaaaaaagataaggaaatagtaataaaaacaggtaaagaaaatttaacaaaagaaattatttctagttcaggtatttatgctaagaataatttaaaaattaaatcaaaagaattgcaatcaaaaggttcaattattaaatctgataataaagcagaaattaatgttgaattactagaaaatcttgctgaaaaagttacaaaagattataaatcatcttatgatatttctaaaacatttagaaaaattaaacataacgaaaaaagtgaaagagcggtagctagttttatttatgcaaaagatttagttttagattctaaaaaaacaaataatgtagggagttatattgtaggtaccgattcaataaactataaatcgggtacaactaagatagatgtcttaaagattaataatgaattagacaaaaattatggtgtagataatggtatattaggtataaactataataaagttaagaagatggaagatgaagcagttgggtctatagttttaagtaaaggtgaaataaaagctaagattgataaagagctagaaataattggaagtagccttaaaggaaaaaaaatctttatagaagctagtgatgttaaaataacttctaaagaacttgacaaaacaacagaaactgaatcaagacaattacttgctggggatttaaaaggtggttttgaaaagaatgctactttagataatatatcagcaaaagtagatatggaattatataaaaatgaaaaaatgatagttaaagaaaaaaaacattcaaaatcagaaattgaaggagaaaaagttacaatagtagctaaaaatgaaaattcaataaaaggttctcaaattaatgctaataatttagaacttaaaggaaaaatagttagaatagaagatgatatttctaaaactgaggttgagaagaatacagtaacggtttcagcgactaataaaattgcagtaaatgaaggaaatttagaaagtgataataaattaataattagtaaaactaaagaaaatttaaatactgaaacttctaattcctcaaatattaatgctaaagctaatgtgaaaatagaagcagacaaagtgttagtgaaaggttctaaaattgaaggacaagaagtagaaataaaatctaaagaaaaagttgatatagttaaatctcaaaccaaagaagattataaaaaggattctgaaacagttacattagggtctaatgttaaattagatgctaaatctgttgcaattattcaaaccttaaagaaaatgtatgatgaaaaagacaatctttcaggatatgctttaaatccagtgtcaggatatcaaaagataaaagaatataaggtaatgctggaaaaaaatattgataacattaaagaattagttgctaatgtttcagataaaaaactagatcctgaatctttaggggtaacgatgaatgttgaaaatagtattaaatacaatactaatcatttaacatcttcaaaatttgataataatgaaagtgaaattaaagctgataaagttacaattaaaacagaagagttatcattagaagcatctaagattaaaggaaatgaagttaaaatagaagctgaaaaagtgagtttagaatctgctgagaaaaaagtaaattcaaacgaaacagatgccagtgttcaagtagctatggtacatgaaattataagtcaaaatacattatttaaaggtgattcaactgttcaaaacaaaggaaattataaaacagaacatacttcaagtaaaatagaagcagaaaaaatagatttaaaagctaaagaattaaaattacaaaattctcaaatagaaacaaaagagggtaaagttgaaactgataaattaagtgtatatgataaggcagataaagaaactaaatatggcgttactctagcaggtatgtataatggaggtacaaaaattggggttgggagtgctacagctaaagtagagcatgatcaaaaagttaaaaatgtatctattgtaaaagttgaaaatggtaaagttgatgttaaaaaagaagataaaaagaaagatatagaagtcaatattgatgttaatactcaattgggattaaatgtagatccaagcggtgatgttaagggtaaagcaagtggtggagcaaaaactaagctagattcaaaaggtaaaaaaattcaaggtacaggttatgtaggtgttattggagatttagcttttgaagatggaaaaatcacagatgtaaatgtgagtactgagcttaaaggagatttgacaattacaccagaaaaatatgttgatgaaataaaattaaaagttaataatcgtttatctatagatcatgatggtcaaataagtaatgatttaactggtaatttatctactgttactcaaattaatactgaaaatatcaaaagcaaattaaatgtaggtgtagacggtaatctagttactaaaaatatggatataattcaaggtggaataaaaggaaatgctggtggagaaatagaagcaatagtaaaaataaatgataccgtcgaatttaaattaagattgatggctgaaggtaatgtaattaaggaacatggaaaatacataaaactagattctgaattatcgtcaaatgctaatttgaatgtaaaaggtgcaactaaaaatgtttccggctacattaatttagctaataattcgagcataaaaattaataacgaaaatggcattaaagattattcaatagataataatgttgatggtaatctaaagtctaaaggaagtataggcgaaaatgtttcaggagacatagacataaatttaaaatcggatttatcgaaaaaaatgtctcaaaatataacaactagtaccgctgttatggggaacggaaatctaaaagttgaaggaaaactagaaaatttagatggaaatatgggattaaatctaaatggaaacgtggcaggaaatgaggcaggattacaagagttaacaggaaatgctaaagctgatggaaaattacatgctcatggagtattggaagcgtttagtggggatgtaacattagctggaaatactgaattaaatgcaaaagtaaatgaagcattgaaattaaagggaaatttaagtggtcattctaatattagtgttgagggacagacagatgtagtaggtggcaaaattcaattaaaacctcaagttaatatatcgggagataatgttaataaattaacaacatttgatacgagtactaatttgaatggatacattgaatcgaaagtgaaaaatgagtatgtaagaaacattaaagcgaacctaaatactatattcaaaactaaaaagtttgaggtggagacttttgaatcaagtcttgatagtgaagttagatctaaatataaggatatagaatttaatttagcttcaggagaaagaatatcattaaaagactatattcaacaaaaaatatctagtgataaataaaagtttaaagaaaagaaaatttttaaaacaaattttgatctgacactaaaaagttggactgctattcaaaggactgattttgatattgtatcggactcagtccttttaattgaatccgttcttcgttgtaatttaatcagttggttatttagtcctcctttcggaggcttgatcaaagagtagttttctgttttataaaattttgggtagtgaataatactcaacgccatatcaacctaatatcaaaacaacatactgaataaacaaattaaaaggatattcctagtgcttgtttcattatttgttctttgacgaaaccaaatcggttagtggtatttaaacctataccacgtactaactttttcaccggattatcgccgttaaagagttcttttagtccctgcattgccactaacattttgactgccgctgttttctgacatcgttcataatgacgcaaatatcggtattcaccaatatccattcttaaagctaaatttttgttaatttcttgtgcaagtataacagcatcttgaaaacctaagttgactccaagtccggctaaggggtgaatagtatgagccgcatctcctactaacacaatgcgatgtttggcaaaactacgtgcataacgtgcagttaatggtataactttgcgttctccacgcacctcgcataatcctaaacgattgtcaaaagctacagataagtttttattaaattcattttcctctgcgtttaagagttcattggcttgttgtggcggtaaagaccacactattgagcataaattttgttgatgtaaaggcaagaaagctaagatgctgtctttgttaaaaatttgtctagcacaattcttatgcgattcggaagtttttacgttgcaaactaaagcatgatgtccataatcacgaaaaatgagcggaatatctgcttgtttacgcacccaagaatttgctccgtcagcccctacaattaattttgccgataacatttgtccatcatttgtggttaaaattgcattgttttcggtgagtcctaaatgatgcggaagtgcggtaataatttccacatttttttgcatttttaccttttgccaaagttgattttgaatcagatgattttcaataatatgccctaaatgctccagccctaaactttgtgtatcaaattgaatttgtgcaaaactatctttctcccaaacatccattttgtcgtatgccgtcgctctcaaattcaataaagcttgccaaacttccaagttttgcaacattttttcgctggctaaatttattgcactcacacgattactaagttgctcaatcggttctttattaggaaatccttcaattacagcaattttcacagggctatttcgcaagctggcagctaaagccaagcccaccatgcctccaccaataattgcaatatcaaatattttcatcgtcattactccaaataaagataagtttaacaccagcctaacgttgctttagcaaaatactgtcgcaataaagaagattgagcaaatgccatcaagccaagattacgcccaatttgtagcggtaataaattattggcaaaaatagagactaaaccatcagttaaactaataatattacgttgatcggggttgcgttgtttcgcatagttttgtaaaacttgatatttcccccaatcttgttgttgtaaataagcttgcgataccacatttgccaaactcattacatcacgaatacctaaattaaatccttgtccggcgaccggatgtaaagtttgacaggcattaccaactaaggcaacacgatcttgaatatgttgtgccgccttatataaatttagagggtaggcaaaacgtttaccacattctttcagttttcccactcgccaaccaaaacgttgttgtaagcggtttaaaaattgctgatcatcaaggtttattatttcttgactatttttgacgcaccaaaccaaagacattaaattgtctttcattggcaataaagcgattggtccttcttcggtaaaacgttcaaaggcacggttttggtgaggttgttgtatcaaaatattactgataatagcggtttgttgatattcacgcacaagctcttgtgtaatacccaccgcacttgctacgttggattgagtaccgtcagctcccaccaataaatgagtgcttaaagtgcggtgatcttctaactgaatgtttacttgctcaacatttcgttcaagagaagaaatagaaacgggggaaaaataatctatattgctacaatcctgcatagctcgcatcattaccgctcccgcctgatttaattcaatgacagcgcccagagccgcaagacaaaattctttagcagaaaactctgcaataccgaaatgccctcggtctgacacatgaatatgtttgataggttcacaaagaggcgttaataattgccacagcgattgcttattcggcaataaaatctgattgaaatgccggcaacttcctgatgataaagcaatacagcgagcatcaaagccaccgtgatgatgctgatgaggaatttgtttttccagtacggctatttttattttaccctgtgtctgatagctgagtgccaatgctaaactcgcaccggtcataccaccaccgacaattacaacatcgtagcgcaagtgcatatttttacccctctttcttcacttaaattattgttgcatcagattttcaatatcctcaatttcttttggtacagcagaggttaaaattttattcccattttcagtaatcaaaatattgtcttcaatgcgaacgccaattcctttatattgttccggtacatttgcatccgtaccgatatataaaccgggttcaacagtcaacaccatgcccgcttctaaagtgcggtctcgttttttactatttcgatctccgttttgcacctcactgctgtagcttcctacatcatgcacatcaagtcccaaccaatgccctaatccgtgcatataaaattgacgataactttggttatcaattaaggtttgtacatcgccagttaaaattcccaaacgaactaaaccctccactttaattcttaccacttcatcatttgcctgttgaatactattgcctgccactaacaactcaatagcacgtttttgtgcttttaatacaatttcataaatttctcgttgtgcctgagtaaatttaccgttgacaggaaaagtacgagtaatatcgcctgcatacatagcaaattcacaacctgcgtcaataagcaacaaatcaccatcttttaaaatttgatcattttcgttgtaatgtaaaatacaagcgttttcgccaccggccacaatactgttataagcgacatatctggcaccgaaacgattgaagtgatgtagtatttcactttcgatttcatattcaaagcgattagggcgggtttgttgcattgcgtgaatatgtgccaaagcagaaatttgtcctgcttgttgtaacaaagcaatttcatttgctgatttaaacaaacgcatttcgtccacaagaactgcccaatctaaaacttgtgcaaattgcacagtttttctattcagtatatcttgtaaaaactcagttccccaaggttgttgagctgaatggtaataaagtgcggtgatattttccctcagttgtaaaaactgtgtttcaaattcggcaatatcataagccaaatccacagacaacgttttcgttgcattttcaatccccaaacgtcttccgttccacgtttccattaagggatctttgggccgcaaaaataaaatactttgtgatttttctgcagttttgattaaaagtaaaatactatcaggttcattaaagcctgttaaataccaaaaataactgtcttgtcgaaaaggataatgacaatcctgattacggattttttcctgagaggaaaaaacgatggtaattgaattatcttttaattgtgctaatagtttcttacgacgaaaaacaaactcatcgttaggcatttttgccatataagcaagatccataaatactccttaatgcttaaaaaacacactgaattctagcataaaaaaacaagtcattcgattgattaaaaaacaaagctaatctatctataaacagcaggcaataagaaaacaacgcactttattaattgagcgagtttagctaaatacattgactaatgtaatacggttgtctttgtttccgataatggtccgaagtgattaaagaataaaaaggtaatcgttctcacatattcaataatttcttctaatgctttagacaactcctcttgatcatctttttcatcatatccaagttgtccaatagcttgtaaatcatccagtgcttcgccgatttcgcctacctctttatttaaattaggctgatttagccctaatcctaataaaaaatggttggtccattccgacagagcatcagctcgagcaaaaacattgtcttcttccggtaaccaaagctcaaaattaaatttatcaatatcggataaagtgcggtcaattttctgataaatttgttccacttctttcaataaggaagtgggatacgcatgatcatcatttgtaaattgataaagaagatactgccaacgttgatctgtaataccaccgcaaattaaaccggtaagaaaaccatgcaattcagccaccgttaatgcaatatttgcttgtttcagttgttgattaaattccgaataaataagaggtttttctgacatttgatatttccttgaaaaataatatgccagtttatcactgtttaacttcagcaaccaagaaacaaagggatttttatgacgaaaattttttgctatggcataataaggacacttttagcttttattataaaataggaaaacacatgtcaaagctcattgaattatccgtatcagggcaagtactacgtttaaattgtcctccagaacaacacgatgctttacgtcaagcggcacatttattagataatcgtgttatggaaatgagagagcgtaccggtattttacagatggaaaaaatcctctctattgttgcattaaatttaagttttgaactgatgcaggaacaacaaaaaactcaaacaatcgaaaatgtcattaatcaaaagattgctcaactcgaaggatctttggagaatattttggctcaaaaaacaactttttaaacataaatctgtgatctaatcgtgataatttgaaaaatattctagccaataaaaataaattgcgttagtattgcactcaaagattacctgagatgtttgccggcggattaagtccctgagccgatactgaaaacttaatgaattggcgtcctgttgttggtgtgtatgcttgctagccatgcaagaaacctaaaaacaatattagccgattcccttgaaccgtagggttcaaggaccgaacatccgcagcggcatctcggggctattcttagttatccagccaatatattgtcccatgagtatttctaatcaacgtcaacaaatacgacaacttattcgagaaaaaagacaaaaactgaccgcacttgagcaagctcaagccgaacaaaatattgcacaaaaagccttggatgcgattgaaaagtttcgtgcggaacatattgccttgtatctttcttttgatggtgaaatttcaacgaaattactcattgaacaactttggcaacaagaaaaaaaagtttatttgcctgttttacacccattttctcccggaaatttattattcttagctttccaaaaagatacacctatgcactacaataaattcggtattttagaacctaagttgaatgtgcgaaatgtactgcctgtttcacatttagatttgatttttacgcctttagttgcttttgataaggatggaaacagattaggaatggggggaggattttatgatagaaccatacaaaattggcaaaaaaaatcttttgtccctgtcggattagctcatcaaattcaagaagtagaacgactccccattgaaagttgggatattcctttagcagagattttaaccggataatgaacgcttaaaacgtttacggcggcgatgaaaattcgccgaagcggtacttttttttattgcatgagtaataggcatcatatcaggcgttttttgtcttgtgcgacgatggtaattcaaaaaataatgaatggaattcaccaataaagcactagctaaaaatagaatgattaattcaccatataactgattaaaaatgtggtttattttacgctgacttgcttgtctatatttcatatcaagagtaatacgtaaaaaaccctcaataccattagatgaataaatcggttcaacaatttgctgaatattcggttgcgtagtattgttcgctttttgatttaagttcaatttatcacgcaaaccgacaaaattcgcactatgtgctaacaatttaccgttagcaccataaacagaagcatcaatcacaaattcttctttcgtaaagtcgttcagttttttggtcaaaaggtccgaattggggttatccgcaaaaagcatagcaaaaagattagcttgctgacgcactaataaattggataagtagttcatttgattaattgttgctaattgtgaccctaatttaaacttattaatcccaaataaaatcaaagacataatagttagacaaagcaaaataatgccgagcaacattccaatttttagtattttttcttttattaagctcaagttattttccctaaaaattattaaataggctagaataagaacaaagaaataatttacaggatcttttatgcaaactcaaaacctagagacaattatctctcattatacgctattcccttccccaattttatcagaaaaacccactgtacttggagaagattacttcattctctatggtaaaaatttaaatttggacagtttattaacttttcaacaaaagtgcggtgaaaattttctgattttagattgttggaatcggttagattacactgttgccttattcaaaagcaattggcaatcgcagtacttaactgttgctcatcaactggaacttgatattgcattattaaattttgatgctcgtttaagtcaagcgggattattagttatggatatggattcgacaattattcaaatggaatgtattgatgaaatagccaaccttgccggtacaggaaaattagtaacctccattactgaacaggctatgcgtggagaacttgattttgaacaaagtttacgtcgtcgagtagaaacgcttcaaggagcacctgaacatattttacagcaagttcgtgatagtttacctttgatgtgcggtttaaccgagatgttggaagtgttacaaaaatatggttggaaaattgccattgcatcaggtggatttacttattttgccgatcatttaaaagaaaaattaaagctggattatgcggtttccaatcacttagcggttgagcatggttttctcactggaaaagtacaaggtgatattgttgatggagcatataaagcggaaacgttaaaatctttagctcaaaaatggaatatagatttaaaaaatacagtagcaattggtgatggtgcaaatgatttagccatgatgaaagtcgcaaatctaggttgtgcttttcatgccaagccaaaagttcaacaacaagcacaagttgtggtaaactttgccgacttaaccgcacttttatgtattttaagtgcaaatgatcggattacaaaaaattaaaattgaggagcatattatgccgtcatttgatattgtttcagaaattactctatatgaaatacgcaatgcagtagaaaatgcaaatcgtgtattaagtacacgttatgattttcgtggtgttgaagctacaattgagttaaatgaaaaagcagaaaccattaaagttacgactgaatcagatttccagttagagcaattaattgaaattctaatcagtgcctgtgttaaacgtgatattcaacataattccttggatattccggctgatagcgagcatagcggtaaattgtatagcaaagaaattaagctaaaacaggggatcgaaacagacatggcaaagaaaatcatcaaattaatcaaagacgcaaaactaaaagttcaaacccaaattcaaggtgagcaagttcgtgtttcaggaaaatcaagagatgatctacaggcgactattcaattagtaaaaaatgcggaattaggtcaaccgttccaatttaacaatttcagagattaatttctatttttcctacagaaaccgccaacaatataattgcacatattattggcgtttttttgtattcaaattattacagtattcttaaacttcaatactagtgtaatttaaagctaataggtactgtaatttggcttggtagcccagcaggtttttgcccaatactgcgtgcactttgaaccgcacttaatgctgccttatccaaatcttctgaacctgaagattttgcaatacttatttgacttaagctcccatcagcaccaatagcaaaactaacagtaacaatcccttgttttcgcatcatttttgcacgttgtggataacgtttatggcgttcaatttcacgacgcaacgcacttttataagcagcaacttcatcagtactatttcctgttccaatcaaattcggattagatgttgttactccgcccaagcccatagcctgcgaatttactttatcgtcagaatcaatatccctatcacctttaggtaaatcttttggctgtttttgttttgtgcgttccttaggtttcttcttcggtttttccttcggcttatctttcggtttctccggttcttttaattttttctccggctcaggtttaattgttggatctgcaactacctctgttactacaggatccggctcaggctcagctaccggttctggcttagaatcatctacaaccatacccattaacatttccattgagatctcagtaccaatcaaatccgcactatatccatttgcactgtcatctggtttagtaaaccaaaaaaaaccgccaattaatgcactatgaaatacaagcgagaagaaaaaaccaaaccaagaatgatatttcttcattacttacttgccttttctttcatcgttacaatagcaacatttttaatttcgttttttgccataatatctgtcaaggttacgaaatcttggaaagtagatttagcatcgacttttaatgtcactttttgctctttatcccaagtcgcaatttcttgctccagttcttctactgaaatgggcttatcattaaaaaaaatctccccttgctcagttactgtcaataattttgctagatcatcggacttgaaagcaactgtgctacttgctttgggtacattaacttgaattttcccttgagaaataaaagaagctgtaattaacacgatggcaagaagcaccaacataatgtcaataaagggaataatattaatttcatcaaattttttcacattactcaccaatattttgctgactgtttaaggctttccattttagacggttaacttcaactttacgtcctaaaccgttgtaaaataccatagaaggaatcgcaacgagaataccgactgcggttgcttttaaggcaagagataagttaagcatgatagcagcggcatcaatatcccctcctgagttacctaattcatagaatgttaataaaattccaattaccgtacctaataaaccgacataaggtgcattagaaccaattgttgagataatggtcaaatgacggtttaaatcaatatccaactcatgaatattcgtgtaactttccactttaattttggtcagatacataaaacgttcaacggaaaaccataacataataaaactcattacaccgagtaaacccaaaatgatgtagtcaatataatgatgtaaaaaattaaaaaactgtgacattggataacattccttgctgataaaaattacaaataagttattgagaattaatttcaattagggtgaggattttaacaaattttattgagagatcaagctataatattaaaaagagactttttgagtaccgcacttttccatctgttttttattttagtgaaatttgacgtttttcgttcatactatgataaagcaattagaagaaatgactaattgaaatactgaaagataagacactagtaattgacatccccctgccttaaggccgggcggatgtcaaattctcaaaaattggctgatgactaattctacgcaccatgcgatgatttcattattctctgccatttgtattgctttttccagtttttcaaaggctttttgaaatgagagaatctatttaaatctttttttcgcttcagctatcgcttcagctacacgtagtggtgaaactccgccttttgcacaacgtttatccaaacaggattgtaaagataagatttcataaacatcctcctctatagcattactaaattgatggaattccttaatacttaaatcttctaaacctttatgtactttaatagcataaactactgtttcacccacaatatgatgagaatcacggaaaggtacacctttggcaactaaatagtctgctaattctgttgagttagaatatccctttaatgccgcttcttttgttctttcaacgctaactttaatatcttctaacacaaaagtcgccatatctacacaatcttgccaagtatccaacgcatcaaaaatcccttctttgtcttcttgcatatctttattataggcaagaggcaggcctttcactgtcatcaacataccggtcaaagcaccgacaactcttcccactttgcctcgaattaattcacaagcatcgggatttttcttttggggcattaatgaagaaccagaggttactcgatccgacagctccacaaaatcagcctctccactattaaaaatgatcatatcttcagcgaaacgtgaaaggtgagccatacttaaagacgcagtggaaagaagttcaataatatgatcacgatcagatacactatccaaactatttctcgttgccatcgcaaaatccagatcttgtgcaagtaaatcacgatcaatggcatacgcagtaccggctaaagcaccactccccaaaggacaagtattcattcgttgataagcgtcttgtaaacgaccataatcacgatccaacatttccacataagccatacaccaatgagcaaatgtgattggttgagcacgttgcaaatgagtataccccggcattactacgtgttgattatgctctgctgtttccactaatttacgttgcaattcacgcacggaatgctgtaattcagtaacacgttgtttacaccacatcttaatatctaatgcaacttgatcattacggctacgcccagtatgtagttttttgcctaagttacctactttatcaatcagtttactttcaacccaactatgaatgtcttcagcatcatcttgtaaaatcttttgtggatttgaccgcacttcaattagtagttcactcaatgcgttttcaagaacttgctgctcttgctgagttaaaacatttacggtaaccaatgctttagaccaaccgattgaaccctcaatatcttgttcagctaaacgatagtcgaaacgcaatgagtcgttaaaatctttaaaacgtttatctgtcgcttgtgtaaaacgcccaccccaaagtgccataatcacatcctttttctgttattatttgtggataaatttagttctcattatctcacacaaagaaaagtgcggtcaatttaaccttcacgatcccttcttaatattaccgctaactgtcatattgatactaaacgactctactttttgacttgatttccgcttgtgttttctcatcgccatccagtacgacatttttctgcttattcggttaaagttaagagttttgatttaaattatgcgttacattatttaaaattactggaatgtatcatcacatttagatgtttgattcaagcaagaggaccttaatgtaatttatttagatcaatagtgcggtagaatttaagatattatttaataataaagggtgataggtttatcatgaaaaatttccgttggtatttaagttatagggcgggaagatttaaacattattggagaaatgtgcagtgtcaaatttatgtagaaacataaaggttttttttaaagtttttttgtatcgctttaaacaaaataaattaaatcaagcagcaggctatttaacttatagtactacgctggctcttgtgccattgattatggtgtttttttccgtttttgcggcgtttcccgtttttaatgaaataaccggcgagctgaaacaatttatttttactaattttgccccttcaaccggtgatgccgttggagaatatattgatcaatttgtcaataattccaaacaaatgagtgcggttggaattattagtttaattgttgttgctttaatgcttattcattctatcgaccgcactttaaactcaatttggcttgatactagtgtgcgtccggcaatattttcctttgcaatttattggctaattttgacgcttggtccgattgttattgcgacgagtatcggtattagtacttatgtgactaaatttgcaacctatacatttgaacaagatttgggtttatccgtgggtataaaacttcttagtttgatgccgtttttcttgacatggtttatttttaccgtgttgtatatggtagttccaaacaaaaaagtgagtattatacattctgccgccggtgcattaattgcagcagttttctttacattgggtaagcaggcttttacttggtatattacaacttttccctcttatcagttaatttatggagcaatggcaacgttgccaattatgttactttggattcaactcagttggacagcagttttattgggagctcaactttccgcagtactggcggatatacgttcacttgattgtggtaatattcaaatagaaaaaattaaggaagaaaaatgattgcattaattcaacgtgttagtcatgctaaagtggaagtcggacaaaatattgttgggcaaattggacagggattgttggttttactgggtgttgaaaaagacgatgatcgaagtaaagcggataagttggctgaaaaggtgttaaattatcgcattttcaccgatgaaaacggcaagatgaacttaaatttacagcaaatcggcggagaaatattaattgtttcgcaatttacgcttgctgcagatacgcaaaaagggttgagaccgagtttttccaaaggtgctgatcctgagttggctgagaaactttaccaatatttcagtcaaaagtgtgcggagaaagtgcgggtcgcaaacggacaatttgcagccgacatgcaagtgagtttaactaatgatggacctgtaactttttggttaaatgtataatataaaaataccgagtgttatgctcggtatttttatttctatttgaattaaaggaatttttcttttaattcttttgcgacagcaagttgtttttcagtcgcttttgctgtcataggttcacggcagtaacctgcattaacaccttgaagtttaaggatttctttaatagttaaatataaaccgttagccagtataccttcgattaagtcatttgtaacatgttgaatctcaagtgcttcagcaacttttcccgcttttgccaattcaaatatttgtcttgcacgtaaaccatttacattaaatgtactaccaattgcaccatcaacacctaaagagactgctggcaacatcatttcatcaaatcctgcccaaactagatggtttggataggcttttttcaagcgttccaataggtagaaatcaccggcggtaaatttaactcctaatactttgggattggcatagagttcaccgaattgctcaacgcccatattgacacctgttaagaatggaattgagtaaacgatcatattgttgccggtttcagcaataatcgtttcgtaataatgtttgatttcggcaaagctgaatttgtagtagaacggcgtgacggcggataagctgtcgtagcctaattctgttgcatatttacctaactcaacagcctcgtgtaagtttacactaccgacttgagcgattaatgcaacttgatcttttgcttcttctttggcaatacggaaaatttcttttttttctgcagttgagagcataaagttttcgccggtactgcctccgacatataaaccgtcaattttcattttatcaatgttataacgaacgatctcacgtaaacctttttcatttatggagccgtcttcgttaaaagacactaataatgcactaaaaataccttttaagtttttcatttgtttctcctgatataaaagggattaaatttttatttaatacgttgttctaaaatcacattaactgttttttgtttagtttgtaccgcactttcttcttccgcttgaacaatcaaggtgtaaattaagtccaatacaaaaagttgagctatttttgtaccgatagaatcgccttgtagctgcccttgtcgattaccgttgattaatacataatcagaaaccatagtgataggggagcgtaaattatgtgtaagagcgacggtaacagcaccgtttttcttggcaatattcaatgcttgaacggtttctttggaatagcctgaatgacttataccgataacaatatcacttgagttcattaatgcggcttgcatatacataaaatgattattgcttgttgcatcaacgtgtaatccaatacgcattaatttattttttgcttcttctgcagttaagcctgatgaaccgacaccaaacaggaagattcgttttgatacacgcattaattcaacaactttttcgagttgagcaaaatccagcaaattaacggtttctgaaatgacattatgaatgacattttgcaatttttctgcgatttggcttgttccatcaaattttgatatatccgtttccagtagagaattagattgtcgatcttttgtagccaactcaatcgaaagttgtaatttgaaatcagtaaagcctttaaaacctaatgttcggcaaaaacgaataaaggttgcttctccgacatcgaattgttgtgcaatttccgctaaagagttttgtcccaacaactctggagaagatagaaccgttgtggcaatccgtttctctgtttttgttaggctatcatacaaagcaccaatggtatccaatatattaccgctcgttgccgccataattgagcctcctgttagcgttgtttgtttcttaatcgattaatgatatcggtattttaactaccaatttttttaagtgggtaacttgaccatgaacattacagcaaggtttgtgcggctcataaggaaaaaatatcgcaaacatttttggacgtaatgttaccgcacttttatgcggaatatcatcaattaactgataatcgtcttgctcattataagcagtacagtctgctaaattcggatattcaacaccatattcaattgtttccgcaccggaaattaatacttgaatatcaatatattgatgatgcaattctgcttttttatcttcagaagccacagtcgttgactccatgacattcatataaatttgatcggttaaatcatgtcgacctgtggtcaaattttctaaatccagcgtattaagatgatgacaaatattaatcatcacttgtggtaagttacgcttaaaatcatctcttgttaaatcaccaaaaatcattttttactcctattattatgggatttgttgcattttcatccaataagccgcaccaattaaaccagcatcggcaccgtatttagccggcgccaaaatacagtgataaaattttggcatgtcggttaaatattcttgaacgagggataagtatccctcagctaatccaacgctaccgcctaaaacaaccttttgtacatctaaactaatcaccatatcagcaattaagttagcaatagcttttgctgaggatcgaacaagtgcggttgctttttcatcatttttacggaacaagttgaacacttctttcggattacaaggtttttcccacttattcgcctcacgttcaattgctcgccccgccgcaatcgcttcaacacaaccacgacgaccgcaaccacaaattgggccgttcggatctgccaaagtatgcccgatatgaccggctataccatttagcccagtggataattttccatcaagaataattcctccgccaacgccagttgataccgtgataaaaataaaatttcgtaccgcactttggtcttgatcttggtactctgcacaaacagcagcctgtacatcatttagcaagccaatcggtttatctgtatggagagcaatgcttttttgtaaggggaaatcaaccagtccaccgagatttttaggattaagtgcggttaaaataccgttgttgataatgcctgtcgatgcaactgcaaccgcatcaaactgtcccgcataactttgcataatttgcttgatggcgtgatgcaatgcgactgtaggatctgcttgtggcgtgctgatttgctgacggttagagagcttcttttcttcaacaacagcggttgcaatttttgtaccgccaatatcaattgctaagcaacgcatacttttttccttaggtttagtaggatttagctgatttaaccgaggtgacaaaccagcttacaatatgttctaagcgagtcaatgccgaaccaacagtaacacaatcagcaccaatttcaatggcggctttagccagttttggtgtgttgtagcgaccttccgccatcacataacaaccggcagcttttaaatctttaactaattgatagtccggttcttcgggaatatcaccacctgtatagccggacattgtgcttcctataatatcaaagcccagttgttggcaatataaaccttctttcagatttgagcagtccgccatggctaaacagcccaattcgtgaatttttttcaccgcactttcaatgtcaacaggacgtttgcgatcggtaccgtcaaccgcaataatatccgcacctgccgctgctaagtcttcaatatcttgtagaaacggcgtaatccgtacaggactgtcttccaagtctcgttttacaattgcaataattggtacattcacggscggacgagttgcttttaagttatctacgccttcaatacgcaagcctgcggcaccaccgataatggaggcttgagccatcgctgcaacaatttccggtttatccataggaccgtcatctacgggctggcaagaagcgatcaatccaccttgaatagcggttaaaacttgtttctgtgataatgttgacatataaaactccaaactatgggaataactgaacgttattccttttctttataaatattgctctaatttacggattagtacctcgtaacctttcggactgaaatgtaagccatcggtacataaagttaaatccaatttgccgtcttcacccacaaaatcctgccaagtatcaataaaagttaaacccttagggcagtttttccgcaaataattatttaatgcaataatcggtgggttgtctgttgtagcaatattatttaccggtgttgcttccaatagaaagaattcggattcaggagaaattttgactaaggcttgccaaatatcacagatccaatccaatactttggcgtgagaatactcaggctctttaacaatgtcattcacccctaagaaaataaagacttttttacctaaacagttaatcaattgaggtttgataataacatctaaatattgtctagcactgacacccgaaatacctaggttggcaacacgtttgcctcttagttgaatttctggtgaaatatcactccacatatcaaagagtgagtgtccaactaaggtaatatcagcttgcttttcaaattccgcttttttaacttgataacggttgaaaatatcttgatctgtcagcaattttcggtccttaatttaacaatattgattaatattggaacgaattatataaaaattgaattttctcgcaatgttatttggtgttttactccagaaattatttaaatttgtgtgccatgtcacaattctgaaataaaactctataaatatattttaaaatgattttttgcttttagaatatactttcagcaacagtgcttttcccttcatatttttaataggagaacttacgatgaaatttgaaaaactcgctcttgcaactttagcgttgagtatgtctgcctctgtttttgcagcagattatgagctgaaattcggtatggttgcaggtaccagttccaatgagtacaaagcggttgaattttttgcgaaagaagtaaaagaaaagtccggcggtaaaattgaaattgcaattttcccaagtgcacaacttggtgatgaccgtacaatgttaaaacaacttaaagacggttctttagattttacattaggtgaaactgcccgttttcaaatcttattccctgaagcggaagtgttcgcattgccttatatgcttccaaactttgaaatcagtaaaaaagcattacttgaaaccaacttcggtaaggggttaatccaaaaaattaataaagagttaaatcttgagttattgtctgtagcttacaacggtactcgccaaactacatctaatcgtgcaatcaacagcattgcagatatgaaaggcttaaaattacgtgtaccgaatgcggcaactaatttagcttttgcaaaatatgtaggtgcttctccgacaccaatggcattctcggaagtgtatttggcgttacaaaccaatgctgtagacggtcaggaaaacccattaccaactatccaagcacaaaaattctatgaagtgcaaaaatatttagctttaactaaccatatcttaaacgatcagctttacttggcaagtcgtgaaactttagaggatttaccggaagatttgcaaaaagtagttaaagaggcagctgagaacgcagcagagtatcacactaaattgttcaaagagggtgaaaaaaatttagttgcgtttttcaaagagaaaggtgttactgtaactactccggatgtaaaaccgttccgtgatgcgttaaaaccttactatgatgaatacttaaataaaaatggtgcgttagggaaacaggcaatcgaagaaatttcaactctcattaaaaaataaaaaatgccctttccctagtgagggaaagggatagcttttttgttcggagtatgtatgaaaataatgaacaagttagaagaatggattggcggggcattattccttgcaattttcctgattttgattgcacaaattgttgcacgtcaagttattcatatgccacttatatggtcggaagaattagcacgtttgctgtttgtttatacggcattattggggatcagtatggcggtacgtgcacaacaacacgtctatattgactttattaccaatttaatgcagctgacaatcaaacgtatggcgatgacctttgttcaattattaatttttgtctcaattattctgtttatctacttaggttatggcgtttgggcagacgcaacttttcctatggaagcattaaaagctacctttggaacggaaattacgcaaaaatggctctacgcagggttgccgattattgcatctttgatgttattccgttttttagaagctcaagcagaaaactttagaaacaaagccacttacttgcctgtttcttttttccttgtaagtgcggtcattatttttgcgattttatattttcagccggagtggtttaaatctctgcgtatttccaactatataaaattcggtaaaaatgccgtttatatcgctttagcggtttggttagtgattatgttcttaggcacgcctgtaggatggtcattatttattgccgctttactttatttttcaatgacacgttggaatatcacttattccgcatcgggtaaattagttgatagcttagacagcttcccgttattgtccgtaccgttttttatcttaaccggtattttgatgaacaccggcggtatcactgagcgtatctttcattttgcaaaaacgttattaggacactacactggtggtatgggacatgtaaatatcggtgctagcttaattttttcgggtatgtcaggatctgctttagcagatgctggcggtttaggtcaattggaaatcaaagcgatgcgtgatgcaggctatgatgacgatatttgtggtggtattactgctgcctcctgtatcatcggtccgttagttccgccaagtattacaatgataatctatggtgttattgctaatgaatccatcgcaaagctatttgtagcaggttttgtacctggcgtgttggttaccatcgcattgatggtcatgaactactatgtttctaaaaaacgtggttaccctaaaacaccaaaggcgagcaaagcagaagtttgtgccgcatttaaagacacattttgggcaattttgacaccgtttttgattattggtggtattttctctggtttatttacaccgacagaagcggcggtcgttgctgctgcatattccgtaattgtaggaaagtttgtttataatgatttgaatctaaagaatttcctcaaaagctgtgtagaagcagtatctattactggtgtaaccgcattaatggtaatgacagtcactttcttcggtgacatgattgcccgtgaacaggttgcgatgaaaattgcggaaatttttgttgctgttgcagattcgcctatcacagtgttaattatgatcaatttgcttctcttattcttaggaatgttcattgacgccttggcactacaatttttagtgttgccaatgttgattccaattgcgatgcaatttggtattgatcttgtcttttttggggtcatgactacattaaatatgatgattggtattttaacccctccaatgggaatggcattatttgtcgttgctcgggtgggtaatatgcctgtaagtgtggtagcaaaaggtgttttacctttcttgataccaatttttatgaccttagtattgattacgattttcccacaaatcattacatttatacctaacttgctaatgctttagcagtaaaactggggattgaaaagatagaagtcggtttatgattgacttctgaagaaatctatttttcaatgtgtatctggataggtatttatttttactcaacttaaataagcaattaagcaataatgttctatattatcatttgataaattaatttatcttaataaaagattaccaatcaatacaaaactcctgtacaatatctcggctttatttttccgcttagcgtgcggctaacgaaaataattttagtaaaagtaaagagcggtggtttttaagattatttttgctagtcgcaaattggaaaatagagcaataagattaacttactaatttataaggaacatattgtgaatccaattgtaaaacaatttaaatatggtcagcacactgtaacattggaaacaggtgcgattgctcgtcaagctacagctgctgtcatggcgagtatggatgatacctctgtttttgtaaccgttgttgctaaaaaagatgtgaaagaaggtcaagactttttcccgttaaccgttaattatcaagagcgtacttatgccgcaggtcgtattccgggtggtttttttaagcgagaaggtcgtccatccgaaggtgaaacattaattgctcgtttaatcgatcgtccaattcgacctctctttccggagggatttttcaatgaaattcaaatcattgctacggtagtttctgttaatccgcaaattagtccggatttagtggcaatgattggtgcatcagcagctctttcattgtcaggtgtgccatttaacggtcctatcggtgcggctcgagttggttttattaatgatcaatttgtgttaaatccaaccatgaatgagcaaaagcaaagtcgtttagatcttgtcgttgccggtactgacaaagctgtattgatggttgaatccgaagcggacattttaactgaagagcaaatgttggcggcagttgtttttggtcatcagcaacaacaaattgttattgaggcaattaaagagtttgccgccgaagcaggtaaacctcgttgggattggactgcaccggaagcaaacaccatattgattgaaaaagtaaaatctattgctgagaatcgtttaggcgatgcttatcgtattactgaaaaacaagctcgttatgaacaaattgatttgattaaagcagatgtaattacgcagattacagcagaagatgaaacaattagcgaaggaaaaattattgatattttcaccgcacttgaaagtcagatcgtacgtggtcgcattttaagaggtgagcctcgaatcgacggtcgtacagtggatactgtacgtgcattggatatttgtaccggcgtgttacctcgcacccatgggtctgcgatttttactcgaggtgaaactcaagcgttagccgtagcgacacttggtaccgagcgtgatgcacaaattattgatgaattaaccggtgaaaagactgatcacttcttattccattataatttccctccatattctgtgggcgaaacagggatgattggttcgccaaaacgtcgtgaaattggacatggtcgtcttgctaaacgtggtgttgcggcagtgatgcctagcttgtctgaattcccttatgtagtacgtgttgtttctgaaattactgaatctaacggttcttcttcaatggcatcggtatgtggagcctctcttgcattaatggatgcgggcgtaccgattaaagcggcggttgcaggtattgcaatgggattggtgaaagaagaagataattttgtcgtactgtccgatattttaggcgatgaagatcatttaggtgatatggactttaaagttgcaggaactcgtgaaggtgtaaccgcacttcaaatggatattaaaattgaaggcattaccgcagaaattatgcaaatagctttgaaccaagctaaaagtgcacgtatgcacattttaggcgtaatggagcaagcaatcccagcaccaagagcagatatttctgattttgcaccacgcatttatacaatgaaaattgatccgaagaaaatcaaagatgtaatcggtaagggcggtgcgacagttcgttctttgactgaagagacaggtacatctattgatattgatgacgacggtacagtaaaaattgccgctgtagataaaaacgccgttcaggaggtgatgtctcgcattgaagatattacagcagaagttgaggcgggcgttgtttataaaggtaaagtaactcgtcttgcggactttggtgcctttgttgctttagtaggtaacaaagaaggtcttgtgcatatttctcaaattgcggaagagcgtgttgagaaagtgagcgattatcttacaattggtcaagaagtaatagttaaagttttggaaattgatcgtcaaggtcgcatccgtttaactatgaaagagttggcaaaagaccaaactaagaatgaagaaaatcttctgcaatcggaagagggttctccggttcaagagtaaatttgatagagtaacttgaagggcaaattatatttgccctgtactgtatctgattactttcatcaatatagtgttttaaatgtgctatccattgaaatttaatcaataatctttttgtttatcttcattgttatttgaacaatattgaaattttgaatgaagccatttatccagcaaaacaagactcaatataagcaagcaaataaagcttgttgtttttaattaggcatatatttccgttgggtatcgttttgccgaacttgtaaaattgattgacaagtaaataatccatgatgaatgaactcaaacatggattccgtgttgtgaaacgagctttacaacgattaattaacctaaggcaaaagcatattgagctttcctttttacattcgagtatttttaatgactgaaacaacaattacttttaatgatttagggttacctgaattcatccttaatgcagtgtccgaaatgggcttttcaactccttccccaattcaacaggcttgtatcccgcatctattaaatgggcatgatgtgcttggcatggcacaaaccggtagtggaaaaacagcggcattttctttgccattattggcgaaaattgatactaatgaaaaatatccacaaatgttagtaatggcaccaacccgtgagttggctattcaagttgctgatgcttgtgaacagtttgtgaagttttctaaggggatgcgtattgttactctgtacggcggacaacgttacgatattcaattaagagctttaaaacaaggtgctcaagtggtcgtcggaacaccggggcgtattttagatcatattcgtcgtggtacattggatctgtcaaatttacagtctattgtattagatgaagcggatgaaatgctacgcatgggatttattgatgatgttgaaaccgtcatggcggagcttccagagcaacaccagaccgcacttttctctgcaacgatgcctgctccaattaaacgaattacaaaacgctttatgcacaatccgcaagaagtaaaaattcagtcaacacaacgtactgcaccggatattacgcaaagctgttggtatgttcgcggttttcgtaaaaatgaagcattgttgcgtttcttagaagtggaagattttgatgctgcaattatttttactcgaactaaaacagctacattagatgtcactgaattattggaaaaacacgggtttcgtgcagctgcattaaatggagacatgacacagcaattacgtgagcaaacattagatcgtcttcgcaatggaagtcttgatattttagtggcgactgatgttgcggctcgtggtttagatgttgaacgtattagtttagttgttaattatgatattccgctggatgcggaaagttatgttcaccgtattgggcgtacaggccgagcaggtcgtgcgggccgtgcgattttgtttgttgagcctaaagagcgtcgtttattggggaacattgaacgcttaatgaaaaaagcaattgaagaagtggaaatgcctaatcatcttgctttacaagaatgtcgccgtaaaaacttcgtggctaaaatcactaagcaattagaacatcatgatctagaacaatatcgtagcttattggaagatttatttacggcagatcaggatcaggaagacattgccgcagctatgttgatgttattacaaggcaaacaaaaacttattcttcctgaagatccagtgtttgaaaaacattcacgacgtaatgatcgtagagagagaggggagcgtcgaggtaaagaaaatccacgttctgagcgtcatgggtatggtactccgcaaccaatggatttatatcgtattgaagttggtagatgtgatggtgttgaggttcgtcatattgtaggtgcaattgcaaatgaaggggatattcaaagtcgttatattggacatattaaactttatgacacttattcaacgattgaattgccacagggcatgccaaaagaattgttacaagtatttgctaaaacgcgtgtattaaataaacagatgcgtatgtctttcgtaagtgcggtcaattctgaggaagagtttgaagccggctcaggtggtaaacgaaaagggcgttatgaacgtgagtttcgtggtggacgtaaatttaatgaaaaaagtaaccgctctttttctgaacagcgtaaagaacgtagagaaagaaagagataaaagcaaaggggctattacagccccttctttctgataaagcaaataattaataaaaattttattaacgactgcggaaaataatacgacctttactcaaatcataaggtgtcatttcaaccgttactttatctcctgttaaaatacgaatatagtttttacgcatctttcctgaaatatgtgcagttacgacatgaccgttttctaattccacacgaaacatcgtatttggcaaggtttctaaaattgttccctgcatttcaatgcaatcttctttagccatttattcctctaaatatgaatgaaaaaataaaaacttcgggattatactctattaatgagaaagacgaaaagaatttattctattaaagggatattatttttatttagttaatattgaaaaatttatcggattgaaaaattgtatttactgactaaaaagattagtatttgactgaagttatactatattttttattaaaaaggataatctatggcaagaattgcaattattcccgctagggcaggttccaaaggtattaaggacaaaaatctccaattggtaggcggtatttcattggtcggtagagcgattttagcggcacaagaatctggtgtgtttgatcaaattgttgttaattctgatggtgataatattctcaatgaggctgaaaggtatggtgcgaaaacatttttacgtccttctgagctggcacaaagtgatacgagaacgatagatgttattttacattatttgaatgaattaaagattgaaaaaggaagtgttactcatcttcaacctacctctcctttaagaagcggaatagatattcggaatgcaatggaaattttttcaggagggtgtaaatcagttatatcagcttgtgaatgtgaacatcatccttataaatctttcattatggaaaataatgagattattccacatagagaaatcagtgattttgaagcacctcgtcagcaattacctaaagcatatcgagcaaatggtgctatctatattaatgatattgaagcactattaaagaacaaatatttttttattcctccaataaaattctattttatgccaactcattgctctgttgatattgacaatacgctggatctgcaaattgcagaaaaattaattcaaaatcaatattagaggttatatttttaaggataaaaatcagcgagatgtgtcgattattcgctatgctaaaattgtgctgtgttagcaattttcaaactttgatttatatttggaaaacatgaacattctcattacagggggagccggatttatcggctctgcgcttattcgttatctactgactgaaactgaacatactatcattaatgtggataaattaacctatgcagccaaccttgatagcttacaaagtgcggtgctcaatccacgttatttttttgagcaagctgatattgttgatcaacctgtgataactcaaatatttgagcaatatcagcctgaggcagtaattcatttggcggcagaaagtcatgtagatcgctcaattgcagcaagtactgaatttattcaaaccaatattgtagggacatttgctttgcttgaggttactcgtcattattggcttaaattgcctgcaaataaaaaagagcggttcgtttttcaacatatttctacggatgaagtttatggtgatttaattgactctgaacaggcttctactgaaagtagcccttatcaaccaagcagcccctattcggcttcgaaagcagcttcggatcatttagtaagagcatggtatcgtacctacggtttacctattctaattacgcattgtgctaataattatggaccattccaacattcggaaaaattaattccacgtatgattttaaatgcagtgaaagggaaacctttgcctatttatggagatggtttgcaaattcgggattggttatttgtagaagatcatgtacgggctttatataaagtattacaaaaaggaaaaatcggagagagttataatattagtgcaaattgtgcaaaaaccaatctagaagtggtgcagacaatttgcgatttattagaacagttagtaccaaataaacctaaaggaataaagcaatatcatgagttgattattcatgtcgaggatcgccttggtcatgataagcgttatgccattgatgcttacaaaatccaaacgtctttgggctggacacctttacaagattttaccgcaggcctacgtaaaaccgttcaatggtatttgaacaatggaaattgcagaaatggttaagactgttagttaagcagagtagtgatacacacaacgacaggtttaatatttcgtatgcagtatataaaatagctaatcattaagaggtatatacaaggtttaaataaaaaacgttacataaaaattaaacaaaaaattaacaaaagtgtgatttttgtcatatttttgtaacatcaggtttattttttcttctatttttgtttacaattcacatcgcatatatcgttgcaattatatcttataatttatttactggagtaagttttatggccctctttttgagtatctttcctatcgttttattaatttatttaatggtaaaacgtaacgcattaccttcttatttggcattaccttggattgccgctgttgtattaattattcagttagttttcttcggtacagatattaagattgtgagtgcaaatattgcatctgcacttgtagcagttcaaacacctatcactgttattttaggtgctattttattcaatcgtttctctgaagtatcaggtgcgacgaatatattacgtaaatggcttggtactattaacccaaatccggtggcacaattgatgatcattggttgggcgtttgcttttatgattgaaggggctagtggttttggaacgccggcagcgattgccgcacctattcttgtcggtctaggtttccctgcgattaaagtagctgttttgacacttattatgaactctgtgcctgtatcattcggtgcggtaggtacaccaacttggtttggttttggtcctcttcatttgggcgacgctcaaattttggaaatcggtgctatgacagcattaattcacgctttcgctgcattggtgattcctttaattgccttaagtttcgttgtaagcgtcaaagaaattcgtcgaaatattatctatgtttatttaagtgtatttgcttgtgttattccatatattttattggcacaagtaaactatgaattcccgtcattagttggtggtgcaatagggttacttatttcaattctacttgctaataaaggtattggcttggctaaggttgaaaataatattgaagctgcggttccttttaatgacgtagtgaaagcattgtttcctaccgcacttttaattgctattttgattatcactcgcctccaacagttaccgttcaaagcgatgatgaacgatgcgacaacttggtttgcggttcaattgggttcgttagggcgttttgaaatcagccatggtttaattttcagcctgaaagacattttcggtacatcaattaattccagctataaattattgtatgtgccggcactgattccatttgttgtaacagtattaattgctattccggtatttaaagtatcggcagcaaatacaaaagatattttcgttaccagcttccaacaaactaaaaatccattctttgcacttgtcggagcattgattatggtgaatttaatgttagtgggtggagatggttcaatggtgaaaattatcggtaagagtttcgctgctgcaacaggagagtattggactgttttctctgcttatttaggtgctgtcggagcatttttctctggatccaatacagtatctaacctgacatttggtagtgttcagttatcaactgcagagttaaccggcttatcaacttcattaattcttgcgttacaatctgtcggtggtgcaatgggtaacatggtatgtattaataatattgttgcagtaaattcagtattgaatatccaaaaccaagaaggggcaattattaagaaaacagttattccaatggtaatatatggtattattgccgcactggttgcattgtttgttatcccgatttttttctaaataatgtatacttttggtaagcagtattctttgatgctgcttacttttatttattttaaattgaaatattggagttcttatgaatgtcaatttttatgtcacttgtattgctgatgtggtgaaggcaggcgtggcaaaaaatacagtattgttgttagagaaactaggttgcaagattatcttcttggaaaagcaaggatgttgtggtcagcctgcaatgaatagtggctatacaaagcaagcattggaaggaatgaagaatttagtatcaacttttgaggtaaatgattatccaattgttgcaccagcaggatcttgtgtttacgcaattaaaacttatcctgagcaattttctcgtttcggtgaaactgaatgggcagaaagagctcaaaaggttgctgatcggtttcatgatcttactgattttattgtaaataaattaaaagtaactaatgttggtgcaaaattaacaggtaaggctgtttatcatccatcttgtagcttatctcgtaaattgggtattgtgaatgaacctttaacacttttacaaaatgtaaaaggattggagcttttacctattactaaccagcaaacttgctgcggattcggtggtacattttcggtaaaaatggcagaaatctccggagaaatggtcactgaaaaagttgagcatattacagaagttgaacctgagtatttaattggtgctgatgtgagttgcttaattaatattggtggaagattgaaccgagaaggcaaaaagattaaaatcatgcacattgctgaagtattaatgcaggaggataaataagatgtcactaaaaaccagtaatcttgcatttaaacagcgtgtggacaatcaaatccataatgaaatgatgcgtaaagcggtagttaaagctcaagaaactatcggtgctaaccgtcaaaaaatggttgatgaattggggcattgggaagaatggcgtgatttagccaaacaaattcgtaatcatgttttagcaaatttagatgcttacttatatcaattgagcgagaaagttcagcaaaatggtggaaaagtttactttgctgaaaccgctgaagaggctactcaatatattcgtcaagttgcgttagaaaaaaatgctaaaacaattgttaaatcaaaatcaatggtaactgaagaaatcggtttaaatgaagtgcttgaaaaggaaggcatgaaagtcgttgaaactgatttaggcgaatatttattacaaattgttggagataaaccttctcatattgttgtacctgctattcataaagatcgtcatagaattcgccaagaattacatgatgccttaggttatgaaggaacggaacaaccggaagaaatgaatgcttttgtgcgtaaaacattgcgtaaagatttccttgaagctgatattggtatttccggttgtaattttgctgttgctgaaacaggctcggtatgtttggttactaatgaaggaaatctgcgtttagctacaacagtaccgaaaacccatattgcagtaatgggtatggagcgtttagcaccaaccttccaagaagtagatgtattaatcaccatgcttgctcgtagtgcggtaggtgcaaaattaacggcttataatacatggttgacaggtcctcgtcttgaaggcgaaaccgatggtccagaagattttcatttggttattgtggacaatggtcgttcatctattttggaaagtgaatttaaggaagtattacgttgtattcgttgtggtgcttgcttaaacacttgtcctgcatatcgtcaaattgggggacatggttatggttctatttatccggggccaattggatcggtaatatctcctttattgggaggttatgaagaatttaaagaattaccttatgcttgttctctttgtactgcctgtaactcagtttgtccggttaaaattccattggcacaactcatctcaaaacatcgtgaacacattgcacaagctggtatgacaccaatgttagaacggttgtctatttttggctttactttagcaaactcaaatccgacgttatggaaaataggtgtaaaaattggtgctaaagtggcggctaaagtgattaaaaacggtaaagcaccaattgaggttggagcgttggcagagtggactaaagctcgtgatttaccaacaccagatggcgagagtttccgtcaatggttccaaaatagaggtaaaaattaatggatttacaaaatcgtgataactttttaaataaattagctaccaaaatgggcagacctcgtcaattcattcctgagcctatgcctgagttggtcaataattatccgacaacgcgtttaactgagttgagcaaaaccgacttagttgatgagtttgtgcgttttgctaaagtgatgatggcggatgttattgaaacaagtgaagctgaactaaaccgcactttactggaagtttgcgagaaatatggtggcggtagtgttattttaaataatgacaaaagattagctgatttgggtattttgcaatctgtccaagaaaaatacgatagttatatttgggatttaaatcaaacggaagaaaattttgcccaagcggagaaagctaatattggtattgtgtatggtgagtatgggttggcagaatccggtggcattgttttattttcggataaagattttggccgttcagtgagtttattaccggaaaaatccattgtggttttacgtaaaagcaccgttttaccacgagttgcacaattggctaagattttacatgaaaaggcacaacgaggagaaaggatgccttcttgtataaatattatttcgggaccgagtgctacagcagatattgagttaattaaagtcgttggtgtacatggaccggtacataaaatttatattgttattgatgacttataattgataattaaatcgttaaaaaaatgaccgcacttcaacataagtgcggtcatttcttatttgatttataggttatggcaacacattacttttaagccattgttcaaattcattattgttcataaaacctgttatacgagcttgttctatttcctttcctgattgatcaaagaaaatgatagtcggcaatcctaaaacagtcagttgcttcatgagttcagtattgtccggactgtttttggtcatatttacttgtaacagtaagatatgctcaaataaaggctgtacatttgaagcactgaacgtatatttttcaaactctttgcaggcaacgcaccaatcagcataaagatccaacatggcaaccgattttggattattagcaagaacgtgttgcaattctgcataattttgaatgcgttggaattgagaatgagaggggtgttgttgaactgcgttttgttcgtgattccaatttgaattgagcaagaatagtgcggtaaaaacaaaggcgataatccaacctaaccagttttttcttaattgaataaaaaaccagacaatgaaagcaaacaaccagcttgcccataaataatcactatattcaggtaaaacacgagaaagtaggaaaataggtaacagtaacatgacgaaaccgaaagcagctttgaccttttccatccaaacacctgactttggtagaattttgttgccaaataaagtaattaacatcagaggaatgcccatgcctagggccaataaatagagtgtaaatgcacccgttgtgagatcgccggtttgagctacataaagtaatgctcctgataatggcgcggaagtacagggagaggcaacaagacctgcaatcattcccatcacaaaaacaccgccaaaagcaccgctcttttgttgttggctgagtaaggtgagtttagtttgtagcgagcttggcagttgtagagtaaagactccaaacatggataatgctaatagaataaaaataacggataggctgaccagtacgtaaggactttgcagtgctatttgaaatggtaatccgattgccgctacaattaatcccaataatgtataggtgagtgccataccttgtacataagcaaagcttaaccccaatgctcgtaaactattcggtctttgatttgcaccgataataatcgctgacaataagggaagcataggtaagacgcaaggagtaaatgcaagccctaagcctaacaagaaaaaacctaatggtgcgtatttgttatttaataagtttgcagcaagttgattttgttcagggtgttgcatggcagtttttcccgcaacacttaacagatctttgttaatagagatttcttgagtttcaggcggataacaaagtcctttggtacaaccttgataggtaatgagtgctttattaaaagaactatccgttggaagattgatggatagatctaattgatggcgataaatctcagtttctccaaaaaattcatcttgatgtagctcagcggtagggaaatgaagattctcaatagaaacacgttgatttttgttatcatcattcactaattcaatgctgatttcttttttatacagataatagttttcagcgatagcccaatgaagatcaagtttttttccttcttgttgactactgaattgaaatgcttcatggctttttaaaaattgtgtttttttaccaaaaatgtttccttgtgtttgagatgcaaaaaaaagtgcggtgaaaaaaatataaaaaatagttaaaatttttttcattcaaatgatccctttctaaatagttcaatcgttcaatttatgcagggcgacataatatctgtggcatcagattaaagcaagcgttttatgatctacgtcatgaaatctagctgtatggaaaaaattatctcttttcacttgttacgataatgttgcaattatacaataagccccgaactgaattggattatattctaggaataaagtatgaacataccgcaaattttgattgttgaagatgaagtgattactagaaatatgttaaaaagtatctttgaggctgaaggctataatacactggaggcggctgatggtaatcaaatgcatcgtatacttgctacatgtgaaattaacttagttattatggatattaatttaccggggaaaaatggtttaatgttggcacgtgaattgcgtgaaaatacaaatacagcattaatgtttttaaccggtcgagataatgaagtagataagattttaggtttggaaatcggtgcggatgattatattactaaaccgtttaatccccgagaattgactattcgtgcaagaaatcttttacagcgtacgatgcaagaaatacctaaatctggcaccagtcaggtagaacagtatagattcaatggttggacattagatttaaattcacgttctttaattaatcctgacggagaagaatataaattacctcgtagcgaatttcgagcaatgttgcatttttgtgaaaacccaaggaaaattcaaactcgtgaagagctattgagaaaaatgacgggaagggaattaaaaccacaagatcgtacagtagatgtaacaattcgtcgtattcgaaaacattttgaagatcatgcagatactccggaaattattactactgttcatggtgaaggttatcgtttctgtggtgaattagaagaaaactaattaatttgaatagggtaaaaagtgtcatccttttggtattttttgtattggtttgcacattgccctttttctaaaaatgaattgaaaatagatctcactactttcactactttttctagtctaatattttgataagaaaagcatttttaagtaayggaaatctcttaaaaataataagtcaaagagttttattttttatttctcgtaagacttgtaaaatatttttcattgcgagatctaatggagcaactaggcgtagcctttcccctgttttaggatgttcaaaacaaatagcaaaagcatgcaagaataaacggtttaagccaagtgcggtcatttgttgattaaaatttttatcaccatatttatcatcaagtgcgataggatgacctgcgtattgggtatgtacacgaatttgatgagttcttcctgtaataggagatgccttaactaaagtagcattattataacgttcttcaatgctaaactttgtttctgaaggcttaccttgttcacttacttttacaattcgttcgccactcgtaagttcatttttcaacaatggtgcttgtatcatcttacaatgagattgccaatgaccacgaactaatgccagatattctttttgtatggttttttcacgtagttgctcatgtaggctacgtaaagcagatcgtttctttgcaataagcaatatacctgaagtatctctgtccaagcggtgtactaattctaaaaaacgtgcttcagggcgtaatgtacgtaatgcttctattgctccaaaatttaatccgctaccgccatgtactgcaaggcctgaaggcttgtttaacaccaataaataattgtcttcaaagataatttgttgttccaactgtgcgactttattcaatttttttgaaataggggtatgttctttttccgcaatacgaaccggtggaattctaacaatatcgccattttgtagtttatactcaggtttaattctgcctttgttgacccttacttcacctttacgcaaaattcgataaatcaaacttttgggtacgcttttcaattttgccaacaaaaaattatcaatacgctgtccactttcatcttcattgattgttagtatttttacactttggtttatgattttttcattaatatgtgtcatttttaaattttttcagcttatcaaattgttatgtatcatagcataaaaataggaattaccttgctaaaatttatttatcagtagataatagagcctatttttgggtaggtaaaatactcaaaactaaataagtcatcattgatcattttttaatgctgcgaatggcgtaagacattaatatatgaagtgatttcttggtagattaaagtaaacgacagcttgcaaaattaaacatttcaataattttgtttgtattaagaaagctattttaacacccgtcttaataacgcattcaatgcatccggcaactgacagtcgagagacaggcattttgtgacagataagaggtagattgcgaagcaaagagcggttattttaatgctaattttgataataaaatttagagaaaatttagacaatgaaaagaatgttgattaatgcaactcaaaaagaggagttgcgtgttgctttagttgatgggcaacgtttatttgatttggatattgaaaatcctggacatgaacaaaaaaaagcaaatatttacaaaggtcgtattactcgtgttgaaccgagtttggaagccgcatttgttgattatggtgtagaaagacatggttttttacctttaaaagaaattgcacgggagtattttccggatgattacgtttatcaaggtcgtccgaatattcgagatattttatctgaggggcaagaagttattgttcaggtcaataaagaagaacgcggtaacaaaggagctgccttaacaacctttgtgtctttggctggaagttatttagtcattatgcctaataatcctcgtgcaggtggaatttcacgccgtattgaaggggatgaacgtttagaattaaaagaggcattaagctctttggatgtgcctgaaggcgttggcttaattgttcgtactgccggtgtcggtaaatcacctgaagaattacagtgggatttaaaagtcttgttacatcactgggaagcgattaaacaagcctctcaaagtcgtcctgctccctttttaattcatcaagaaagtgatgtgattgttcgtgctattcgtgattatttacgccgtgatattggcgaaatattaattgatagcccgaaagtgtatgagaaagcgaaagcacatattaaattagtgcgtcccgattttattaaccgagttaaactttatcaaggtgaagttcctctgtttagccattatcaaattgaatcacaaattgaatctgcgttccagcgggaagtaagattgccttccggcggttccattgttattgatgctacagaggcattaaccgcaattgatattaactcggctcgttctacacgggggggtgatattgaggaaacggctttaaatacaaatttagaagcggcggatgagattgctcgtcaattacgtttacgtgatttaggcgggttaattgttattgattttattgatatgacaccggtacgtcatcaacgtgaagttgaaaatcgtatgcgagaagctgttcgtcaggatcgtgctagaattcaaattagccgtatttcacgttttggcttactggaaatgtcacgtcagcgtttaagtccttcattgggtgaatcaagtcatcatgtttgccctcgttgtcagggaacgggaaaaatacgtgataatgaatctttatcattgtctattttacgtttacttgaggaagaggcattaaaagaaaataccaaacaagttcatactattgttcctgttcaaattgcttcttatttattgaatgaaaaacggaaagcgatccatagtattgagaaacgtcataatgttgatattgtggtagctccgaatgaagccatggaaaccccgcactttagcgtttttcgtgttcgtgaaggtgaggaaataaatgagttaagttataacttagctaagttgcatgaaatgaatgatgagacttatgttgttgaggacgcttttatttctcgtcaccttgaaaattcagcagcaacagtggaaagtgcagtcgagaatgcggcggtttcattagctattgaaactccagcaccaatgccacaagaaagaaaacaagagagagaatccttattgagacgtattattgaggggattaaaaacttgtttgctgataattcaagtaaaaataaaaaaaacaaaaatactcgtcagaataaaaatgctcgtcataatcgtcgtaaccaagatcgtcgttctagccgtcgtattcgtcaagagcatgagattaaatctgatgaaaataataaattagatacacagcattctcattatactgaacgttattctaagcatgctaagaaaggcgttgatgatccgcaaattcagacaaagaaagcgggtgagttggaaattcatacaaaagatgatgagactattgaaacaattcagcctcgtcgccaacgtcgtgatttgcgtaagaaagttagagttgaggaaaatttagttgatacgccaaatttgggatcaactgaagaacacgttgaaaatgaaaaaacaatagagcctgttacaagtttagaacaagcggttttacagacagaaaatgagaaaactcatgaacgtcaagataataactatcgtcatcgacgcttacctcgtcatttaagagtgaataatcaaagacgtcgtcgtaatgtagagttaaaatctgcgatgcctctatttgctgcggtagcatctccggagttagcgagtgggaaagtttgggttgatgttaatgtagttaattcaaaaaataacaattttttatctgtagatgaattactaaaacagcaatatcaacaagaggaaattgaagttgttattcctgctagtgaaatcttgatggatactcaatctgatgatattaagcctttaagtaactttgttagccaaccagcaaatgaagcagttgaaaagaaagttcaagaaaccttgcaacgtttaactcaagaggtggttgacgaatcatcaacaatcgaacgcacagaggtagatactaatatttctgtacctgagtttgtacgtgaatatcagtttaacggacgattggggacaatttctgcggttgtgcatacgaaagcagaaatgacacttgccaagtcaagtgatgagccaatacagcctttctcaatcgttgaatggcaagattctcgttattatttctatggtagaggagcggcaggacatcattgtgcaatcagccatgtttattctgaacctgctaatactaaaatagaataaatattttacatgaatgaaaattccacgcttgaatggaacatgaggaaatcatggacaatacaggcgtggatttttgtttttataaagtcataaaataggtataacgaagaaaaatctatagaataactttcttagttctgatggaaaatatcgtaaaacttctttttgttctttcgcaagtgagtatcggcttaaaacactctgtcataggtacattgtagtagagaagagtttgccatagtttagaaattttgaaaatgtttcaacacattgcaggataggggttaaatggtcccccctaccggacttgaaccagtgaccaagcgattatgagtcgcctgctctaaccaactgagctaaagggggacaggtcgtgaattatattgaataaaaataataaagtctataaaaaggagattaaaagcttaaaattcattcaatctcttgatttcaactattaatgtgcctcatcccaattatcacccacaccaatatccacaattaatgggactgataaatgtgccgcattttccattaaagacttaattaatgcagaatattcatctaccttattttctttcacttcaaataccaattcatcatgaacctgcatgatcatttgaatatcattttttttgatttcgttatgaatagcaatcatagctaatttaataatatctgccgcagtaccctgcattggtgcatttatcgccactcgttcagctcctttacggcgtattgcattagatgaattgatttcaggcaaatatagacggcgtccaaataatgtttctacatagccctgctcttttgctttttctcgaatatcaaccataaaagtttgcactcccggataacgttggaaatatagatccatatatttttgagcatttgtccgtgaaatgccaagttgattagataaaccaaaagaactcattccataaatcaagccaaagttaattgcttttgcacttcgacgttgttcacttgttacttcatttaatggaataccgaaaatctcagctgccgtagaacgatgaatatcttttccctcattaaatgccgtaatcaagccattatcttgagataaatgtgccataattcgtaattcaatttgtgaatagtctgcggcaataattttataccccttacgtgcaataaaggcttggcgaatacaacgaccttcttcatttttaatcggaatattttgtaaattgggatcactggaagataaacgtcccgttgctgttactgcttgatgataagatgtatgcactcgtccggtttttttgttcaccattgaaggcaatttatcagtgtaagtagattttaattttgctaatccacgatgttccatcaataatttaggcacaatatgtccctgttgagctagcgtttccaatacatcttcatttgttgaaggtgcaccttttggggtttttgcaatgataggtaaggctaatttagtaaagagaatttcttgtagttgtttggttgaagctaaattaaattctgctcccgcttcttgataaacttgttgctcaagtgcggtcaatcttctcgcaattttttcagattgctttaacaatgcctgactatcaattagtacaccattgcgttccatctttgataatacttttaccaaaggcaactcaatatcattaaataccttcactaaacttggcgattgttgtaattcttgccagaggacttgatgtaatttcattgtaatatccgcatcttcagcagcatattctgtcgcttgagcaatggcaattttatcaaacgttacttgtttttttcctttaccgacaatactttcaaattcaataacttgatgtcctaaatatcgttccgataaggcacccatattatgtcgtcctgtgctgtcaagcacataggattgtagcatcgtatcaaaacaaacaccgtttaattgaatatgatgattggcaaaaatagttaaatcatatttaatattttgtccaattttttgaatagacggattttctagcaacggctttaattgtgctagacacgtctctttatttaattgattttttacaagctcaaattgttcagcattttgttctgattcagtgaataaatctgtttgtgtcatttcttttacagcttgtttatgagccagaggaatatagcaagcctcgccgttggtcagtgcaaaggaaataccgacaagattagctcgcataggatctaaagcatcggtttccgtatcaacagcaataagatctgcctgttgaagtttttccagccaactatttaatttctcttgagtatcaatagtttcatatgaagtgcggtcgattttaatcgtttttttgaccgcacttttcgactcagaggcactatttgtttgagttttatcaagtttaatttcttgctgagttgctttggtaagtgagctttcaccgcttatcacttcgtttagccaacgtttaaattcataacgagcaaagtattcaatcaattgatcttggttattttgccccaacacgagttgatccggtgtaatatctaactcaacgttggtttttattgttgctaaaaggtaagataaatccgcatctgccttggcggaggatagtttctccccgagtttttttgctcctctaactgataatccagccactttttctaaatttgcataaatttccgccatactcccaatgccttgcaacaatcccaatgctgttttttcaccgacaccgctaactcccggaatattatcggagctgtcgcccattagtgctaaataatcaacaattaattcaggcggaataccatatttgtctattacaccatctctatccagtaaactgttattcatggtattgatcaacataatattatcatcaaccaattgtgccatatctttgtcgccggtgctaattagaacgttttttccctgctgagaggcctgaaccgctaatgtaccgattacatcatcagcctcgacaccttcaacagacaacagcggaattcctagtgctttgataatattgtgtaatggctgaatttgttgacgtaaatcatctggcatagggggacgatgggatttatattgttcaaatatttcatcacggaacgtttttccctttgcatcaaatacaaccgctatatgggtcggttgaacctgagcaattaaactttttagcatattcaatacgccatacattgcacctgtcggttcgccaagagaatttgttaatggaggaaaagcatagaatgcacgatataaataagaagaaccatctacaagaacaagcggattttcagcaattttagccataatagaataatctcaaataacacaaagagcggttattatagagcaaatttttgagggaggcgaatttgaaaccggaataaacaagactgaaaagaatatattttaagcaatgcaaaataaatccttagacttacgcaacttaaagcaatacaatttcccatcaattttgtcgatgtttttaaccgcacttttaaaccaaaagatcttatgaaactcaatgctcaacaacaacaagccgtagaatacacacaaggtccttgcttagttttagccggtgctggctccggtaaaactcgggttattattaataaaattgcttatttaattgagcattgtggctacttaccaaaacaaattgctgctgttacatttactaacaaagcggctagagaaatgaaagatcgtgttgcacattcaattggtaaagaaaaaacaagaggtctgcttgtttcaacttttcatactttaggttttgacattattaaacaagaatacaaacatctcggttttaaagccaatatgaccttatttgatgaatatgatcaaatggcattattaaaagagattacggcagatctattaaaagaagataaggagctattgcaagagacagtttcggcgatctctcgttggaaaaatgatcttattcttcctaaacaagcgttcactcaagtaagagacagcaagcaacaaacttttgccaagtgttatgagcgttacaataatcaaattcgtgcctacaatgcattagattttgacgatttaattatgttgcccactttattatttctccaaaatcaagaagtgcggtctaaatggcaagaaaaaattcgttatttattagttgatgaatatcaagatactaatacaagtcaatatgaattggtgaagttattagtcggtcaacatactcactttactgtagttggtgatgatgatcagtctatttactcatggcgaggtgcacaaccgcaaaatatggctcggttaaaaaatgattttccacaattacaagttattaaactggaacaaaattatcgttctaaccagcgtattttgcattgtgctaacatcttaattgcaaataatgatcatgtatttgaaaaacgtttattttctactttagagcaaggtgaaaaactacaagttttggaggcaaaaaatgaggagcatgaagcggagctggtcgttggagaattaatcacccatcgttttatgtataaaaccaattatcgtgattatgcaatattgtatagaggaaatcatcaatcaagactattcgagaaagtcttaatgcaaaatcgaattccctataaaatctcagggggaacttcttttttctctcgagcagagattaaagatatgatggcttatttacgtgtactgataaatcaagatgatgatgcggctttattacgtattattaatacacccaaacgagaaataggctccgttactttggcaaaagttggaaaacttgctcaagaaaaacatattagcctttttgacgctatttttgattttgacttaattcaccaactcaatcccaaatcctataatgccttacaaggctttgcatattggattgtcgaactcaatgatgaaattcaacgctcagagcctgagcaagcaatcaaacgaatgttggcacagttacattatgaagaatatttatatgaacatgccaacaaccctaaaattgcagaaatgcaaagcaaaaatgtagccacgttatttgaatgggttgcagttatgctaaaaggagatgagttcaatgaatctatgtctcttagtcaggttgtcagccatctgacgttacgagatatgttggaacgcaatgaaactgatgaagaaagtaatcaagtgcaattgatgacattacatgcatcgaaaggtttggagtttccacacgtttttttaatcggaatggaagaaaatattctgccacatcaaaccagtattgatgaggataatgttgaagaagaacggcgtttagcttatgtaggtattactagagcacaaaaatctctcacattttctttatgcaaagagcggaaacaatttggtgagattttcaagcctgagcccagtcggtttttatctgagttaccccaagatgatcttcaatgggagagaaatgaaacacatgcaacagaacaagaaaaaaaagaaatgaaaaatgccggatttgccagtttaagggcgatattaaatcaataatgctacctattataaattttatacctactttgtagataaatcagacaaccaaataaattttataaaaaatcgtttgacttatttttagaaaaacgtattataccgcccacaaaccgattgaggtgagatggccgagccggctgaaggcgctcccctgctaagggagtatggggtcaaaaactccatcgagggttcgaatccctctctcaccgccatttactcagtgcatccgtagctcagctggatagagtactcggctacgaaccgagcggtcagaggttcgaatcctctcggatgcgccatgttgatttttgattttattgaactctacaataaaacgtacacaataatacattcggttaaaaatcaaactaatacgcacccgtagctcagctggatagagtactcggctacgaaccgagcggtcagaggttcgaatcctctcgggtgtgccatcgacaaaaacccctgataaataaccatatatagccccttgcgatctagcgtgataattgcttgaaaatcaagtattttccgcatattcaaaaacaaagtattgtatttatatacagtataaattatgatctaaaagaaccgattacagaatttaactgttaccaaaaactgatccaaaaacaaaaaaagtgtaccaaacaaagaaaaaaggggggatgaaatggcaacttaccaaaaacggggagagaaatggcgagcaatagtccgcaaaaagaacgttctaaaaacaaaaacatttcgcacaaaagcacaagcgttcgcatgggcaaacaaaatagaagcggaaataatggaaaatttatatcaagaagtggctaacatccctctagaaaaagtgatagacagatacctaaacgaagtcacaccacaaaaacgaggagcaaaaaaagaacgacaatttctctaccgtttccaagcattacccatcagcaaaatatcactgagacacctaaacgaagacgacttcaaacaatggcgagatgaacgactaaaaaaagtctcctcagcaacagtattaagagaatgggcggtcatcggacacatactaaacgtcgcaatcacagaatggaaactactcaaaaccaacccactaaaaggggtcaaaaaaccgaaagcccccaaaccaagaacgagacgctacagccaacaagaaatagatgccttagtctatacatccggtttttcttggaacgaaccgccaacaacagcgaccgcaagagtaggagcagcgatattattcgccatagaaacagcaatgagggcaggagaaatagtcaacctaacatgggaacacgtccattttgacgacaaaatagcccatctcccacaaacaaaaaacggctggtcaagagatgtacccctatcaaccaccgcaataaaaatattaaaattattggaacaaatcacagagggagaaagcgtatttcaactaacaacctcaagacttgatgcattattcagaaagctaaaaaacagaataatggtagaagatctccattttcacgacacaaggcgagaagcactaacaagactggcggaaaaagtcgacgtaatgaccttagcgaaaatatccggacatagagatctaagtatcttacaaaacacctactacgccccggatatgaaaaaagttgccttattactggattaacgttttgctcgttgacgtttacgagcaaacgcaatcacatcgcctgcaatccaacgattagcagaacgtccacccgtgcgacattgcaacttcaccgcatccggaaaatccggatcggacataatagaacgtttcgtatgctcatagctcatcttaaaataattagccacatcttgagccgtccaaatagcttgattagtttgcgtatagtttgccaccttcaacaactcacgcacagcttgcaactcccttaaaatatcctcattggttatcgcttctttcatcgcttccataaaaatttcctctaaaattccttaatttctctaaaaaactcggctcattatgctcattcccataaaacgaacgtaaaggcacagagtgatctgaaataaacacctcatcattgataagtttcaccgatgtcatcgcattcaatctaaccgatctacctttcaacaaatgattaattgcatgctcattcaacggtttcccaattggtcgtatcgcttcttttattttttgaacaatttcctcccttcttactaaattttcaaggttacagttactgacacaagtccaaggttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtattgattaacctcgctttcctcataatgcaaacacaacggcacatccttacgcaacgccaacggacccccaagacgtttcataaaagcggcataatcgccaatatctgcacaaattcttgcctcttcaaccaattcatcatcagcttgaccggcaacaagacggcgtaattcacgccacacaccgacatatttatccccataaaattgaaactgacgaataccccaaaggctcgcccatgctctcgcttttttagcattatcttttaaactcatatcggcatcttcatcagaccgctcaccatctaaagcaaaaccattaatattttttgaaatatacttagcaatataccccgttgccgagcccttagttttatcgcaatcttcgattttacagcgatgttttttagcccccatttcatcaccgtcaagctccaacgctttttcacgaaacaatctcaccacctcttcacgatgcgtctcatggacataaaccaacaaatgccaatggggcgttgcgtcatgatgaggttcagcgacacgcataccataaaaagcaatattacgttttttcaataacgccctgaattgcccccaaatcttattcaaatagtcctgcgtttgcttaggattagcccctttccatttcttattttgcgtaccgtcattatggattgcatggaatgatgaaggggcggtcagcgttaaaaacaacgcatgatgatcggactcctccgcccactcctccaaccctctcaaacgggtcatcaactcaatccgacgctgagcaggattcgcagaagatttcaaatacatatcaaacagctcagcttgctcactcggatcgtcgatattctcaataatcatctgtttcaaaaaatcatagtttttcttaatctcatgcaaatactcagaaaaaccggctcttgaaatataattgcttctgcgtttgcaaacctcgccacaggcaatcgcaacatgctcaaccatctttttctgcaccttccgcatacgcttaaaccaatatttctcacaaataatcttatgaaaaaccgtatcaatataatccaatctaaccggctttcctttcttaaacttatcccaatgtgaaacaggaaaaccaatattttcacaagcctcaccgcataactgataaatcttccgcatatgctcattaaactcatcatcgcttaaatccgaccgccctttttccaccaaatccaacatataaccacgctgaacattagcaaacagcgtagccaatttataagcaatctcctccagcttcttctcgctcaacaaataaaaaggcatttttgcacgttgacattcttgacggctataatgctcaaaattcttgcgtaacttcaaaatctcatgttgctcacgcaacaaccggctttcatattcctccggctcgccggttaccggcaataaatccccattgtgcggttgttttttttccaacacatcaaaggacaaatccgctaaccatttcggatcacgctcatcaaacgccaacaaccaagccatattgcaacgatactgatcgaacacaaggcgtaaacgagtacccaaggtttcacgcaaccaagtattagcatgtctacgttgtttattcccgaaagcaaacgaaatcgacccgtcatcctcgacagaacgatactcatttaaatacaaatggcgaaaatgctcacgttgtcgttcacgtggcaatttcgccaataatttctcaacaaacacatagctttcgggaacagtattaaaaagctccatctgagcttgtgtccctgttttttcctctttatgaggaacacgaggggaaacctggaaaaaaggcaccgcagtttccttttgctcgtttttaaataccgtcacgaatgccataaaagcctactcaacaacttaaaacgatggcggaatatgagccttcaactctcgcacttccgcataaatcgcctgcaacacattgagaatatcaaacaacgtattcacatcctcattgcgtaactcacaacgaattaacgcctcaatgacatcctcaaattttctacaacacatcacctgccgagccgagctacctttctgctccaacataaaaaccgctttttcgcccggctcaacctttaaaatctcataaacaccctgacgaattcgtaacaaataacaatcagaaagctcaaaaatataatccgtcatacagaccccttcacaataaaatcacgctttttcacccccgcatgatagaacggcaaaagtgcattcaacgtactaaaaatggcatttgaaatcttcttctgcccggattcattaaaatgtatcaatttagaatattgataattcaacggatcgaccaaatccgacgtctctaatttcgccttatcaaacaacgcatatttctgctccatcggcaaggcatcaaaaatacgctcggcagcattaggcgactgatttaaaatacgccgcaaagaagcaaaccccgccttagaaaccgcctcatgatcgggtaaccgctgaacaataatgctctccacatcaaaatgacccataactccccctcaagcctagcgagccaaaaaatcccaaaacgacgtcaaaaaacggcgaacgcaacctggtttcggcggttgttttttcacagcgggcaacacgacacgttccaattcgcttaaacgttgcaaaatttcctcattagtgatttgataactttgatgaagctcaatatttaccctattcatttttttttgtatttcaaatttacgttcaatatttgccaaacgcttttccatcttaaaaagattgatacgttttttattcattgcagtacatttttgatgaaatttttgtttaatcatgttgtgtttcctcatatgtgttgttttccatttrkgcraatrtgattgcctactgtaggggcggattacatccgcccttttttaggttgcaaaaacccacgccattaaaaaacagcgattttttatctaaaaagaaagaaataatagattacgtgtcttcgtcgattggacttgcctcaaacaaatccttcgtatttgtatcactttgtaacaacggtttattaatccgctttacctccggacgctcatgataagtaggcgtttgcaccgtcacaatttcgctataaatatgatgtttagtagaacaactattacaaacccaaattgcctcaatcaccaacataccgacggattcagaatgacgaacccgcatactatgactaccgcaattggcacacttatgattcatatttgccatctttacgctcccagcattgccgaataacctcccaatccacatcagggcgtaaatcctcgggcgttacctcgccattagtcgccttgataagggacgggatatatttcacatccatttttccgccgtttagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgaaactcgctcccctaaaaatatagttgaaatagcgaccgcacttggcgttgatgtgcattggttaaagacaggcgaaggagaacccaatattacgcctcattcttctatattggtgagcaatgaacccgacgaaaagcatactcaccgcataaaccgatatgattttcaactatccgccggagacggaatcattaactcggattacccggagaccatttcgagcatttggctcacccctgaaggtatgatgcaaataatcggacgttatagtgaaaaagggatctgtatttttaaagtccccacggacagcatggaacccaccatctcatcaaaagacctcgtttttattgataccaatattacctattttgccggcgacggaatttatgcctttcgacttaacggcaaagactacataaaacgcctccaacaactccccaccggcataatccgagccttaagcgacaacaaactttacgaccctttcgacattacagaagaattattcgacaccgcagaaatcgtcggaaaatttatccgagtcgtccccctcaacccaaaggatttgtaggggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatttttcctcgccaccattaatatccaactccaattctaacgaggttgtaaatccgcttgtggtgagattatgggtaactttactgataatccagcgactactgtcaatctgatctttaaaccctcgtacttttacacgcaattccggcataagcaaagcattcccatcagctaaattaatagacaaactcgcaatcccccttcgcattttgtcaaaagcagctttagcagcattgatagcataagcttctgttttataggtatgtctcaaggttttcatcttattgctatcggtttccaccggttgagtttgaacaagcgtaacttttttcttggtttttgaggtttccgtgcttgttccgccttcctctgtggggtgtgtcggttttgccaagcgttctattttggtatttttatcaattaaaaccacgcccttttttccattatccatattatgccaataagcacggactgccgtataattatcgttttctgtcaacgaaaaagaaaaattgtcgcccatctgccttgtaatctcaatggtcggcaaggctttaccgctcacagtcaaccccattcccaccggcataaataataatttaccgtttttcaccgtggcaatggcatcgtaattttccgctaaacgacttaacaaattaatatcactttcattggtctgatctaaatgcggaatcactttttctttaaacgcctcggcacaagccccctcaagttgattttcttttgcaatctgattaatcaaattttcaaatgaaatattatcaaaggaacgttcttttttatcgctaagtgagcctctcaaatccgcacttcttgcacgaagagtaagactatccggacttccgctatattgcagttcatcaacaataaatttacctttagggattaattgctccccttgccaaccaatggctacttcaagcattgcaccacggcgaggaaacgccaatttcccatcatgatcacttagctgaatatcaatttcgtccgcctcaaatcccctgttatcagcaatcgtcatcgacattaagcgatggctaattagcgtagtaatgtcttttttgttttcatcttgcgttatcaccctcaagcgataatgaggaatccgatgatgatttgctacagtgcggtctaaaaattcagaatagctcatagttcaattaaactctttaacgtatcgccaatatcttttaacaaactttcgtttgtccgttttaacttcattgaaaaatcaatgcgacgtgaagcaccgtccgcaaaaaaataggatttcccgacgctaatttcctcaatgacaaaccagcctaaaacaagaaaagtactcccatcaattaacggcaagggctccccctgttccgctaaggtttcaagggcagtaatactgagagtagatcccgtaatttcaggcattaacacgccattaatggttaatgtttcgctatcctttcctgtaaattgtgttttgggtaattcccctatcactgaatttgtcggatgtcgccacgtaatagttctttgtgtctcctgataaggtatcgttgaccgcataaaaacaaaaaaaccatacgccatcattgcattagattgaatcattgcttttccttccaaagggctaataaaaagcggtgaaattcgtcaaatctcaccgcactttttacacatctacttggcttctttctcttgctttttcacgccacaacatcaattccgctaaatccatttcatcaaatacagccggcgaccaatgaaaaatagtggcaatatccgcaatagcgtcttctacgcaatgaggaataactaagcctgttgtgtcgccgttgtattctccgtcgtatcgttcgtttccgttttgacgaaaaaaccgattacctccgaacaaagggcggtaaaatcaatcggatcaaggtttaaaatttccattttccctaaagacggttgcgttacacgtggcaacagttggcaataagcgtcaacgtccatttgcattacatcaaacatcttcaagcctttaagggcattaacatttggcttaattaaacgaatttcattgatttccgtttcgccacgttttaacggctgaatcagtgtaacagttttatttttcatctttttttccttacaattcctatacgattataaaccgatggctcggcgatgttcttttaagcgatctacaccattgacaacaaaaacatgattaattaaatcaatttcaatcagcgttttaccgttgacgatttctttgtaatacgtgagtgaagccttaaaggtttcttccgtatcatcgcccactttcgcattacccggatcaatttccgtataacgcccacgcataactaattcaacagcggttacttcgcccgtgtcatcacgttgataagcctgcgacaaacgcaacagtacgccgccaatttctgccgaaccgaataaagcacgcatattctccatatgcccaccgaattttaattcagcctctaatttttctaagcctaaattaatatcgacttcgcctaacatatcgcctgcacgataactttccgctttaatggcgagtttggggcgagtaacctcgttgacttgccctaaataactttcgccgtcttggtgtaaattcattaattttaatttattgggtaaagacatagttcatctcctaagcagcagcgactttagatgcaaattcagttaaataacggtcggtaatacgttgacggaaatttaaattttctaacggcggtaccggtgtatagtcatagtcaatatacaaacgccccgcttttaacgtctctttgctattaatctcagcgtcataccaacagctggcgtcaacaagatagcctaatgcgacaagttccctaaatttcgcattcacaccctctataatgtctttcactaaggttggggtcatcggcttatcaattgcccaggcgtgagcctccgcaatcgtatcacgcaaaatttgagcggtacgtgtatagttttcaaactggaataacggatcggcagaacaagtacgagacccccacaaacgataaccattaaaattaatcggtacagtgacgttatgttcattcaggtaattggcgtctgtactggtatcttgaatatcaaaggtaatatcacgactcaccccgctcaccccctcgacaaccacattagaaatcgttttatgccagcccatagttttatctaaatacgcacgcaatcctaacgcacgagcaaccgcactttcattttcaaccttcttactattaacatcaaaagctaaaaaatcaccatgaataaccataacttcacgctgtccaaatcctttttgatattgaaccgcttgctctttggtttcgcaaccatgagcggatatatacgcaaacgcatttaactttttagcgacgctggctaattccgtggcaacggctttattatccaagtaaggcacacccaaaatacgaggttttacgccgattttactttgggcaactaacaaggctttcatacccgtatactgtcctttttctgttaccgtaccgataatatttgccgtggtttgtgcattatcagtttcagtgtcgctgacgctttcgtcttggacatcgctctcactatcgccaccgcttcttctcgtggctttggttttgctttttttgccttcttctacacgcactacaacagtcaacgtattgacctgatcactaattgcttcaagggttttcgccaacgtacccgtcttgcccgctttagcaatcgcagtcaacggattcgttaataaaacaggggtattaagtggaaacgcttcactatcagcatcatttgcggtacaaacaacaccgataaccgccgttgccacggtttttattgtgcgagtaccttcgttaatctcaataacacgcacaccatgcaaataatccatattaaaatcctttcggttaagttaagggaaatttcagacatcttaggaaatcttaggaaatctcagctattgtgcaaggtcaaaaaagagcggtctagtggcttgaaatgtgaaaaataaattcacctgcacccgctaagaattcctatcgcattgacaaccataaagcgtacattataatgtacataaaaataaaatagagaggttcctagatgctaaatacaaatatcacgaattttagaaaaaatattttttcactgttggaacagacgattaaatataacgaaccggtcaatgtgagtacgaaagacggcaatgctgttattatcagtgaagaagattataacgatctgatggaaacactgtatctttcttctattccaacgatgaaagaaaacatcatagagggattacaaacgccacttgatgaatgcctgtcagaaaacgaggtacagtggtaatgtattccatcgtttatacgaaaaaagcagctgatgatatacctaagctcaaatcggcaaaattggagaaaaaagcgaaggcattgatagaccttatccgtgaaaatccctatcagacacccccgccttatgagaaactgctaggcgatttacaaggggcttattcacggcgtattaatattaaacaccgccttgtttatgccgttttagaggaaaaacaaacggtaaaaataattagcttgtggacacattatgaattttgagaaatgaagaaaccgcccttgttgagagcggtaactaaaaggaacgggattatgtattttaagttgttaatcctagttatcttaatcttaataagcacgccagcttattagattagaaggctaaaagtcctggcagagactgccatctctgctaggcagttcctaaatactacaaccacagctattaaaaatcaacaatttataggaaaacactatggcaatgacaaaacaagaaattcaagcaaaaagcgatgctaagcgtggtgttcggttgcaatcctacaaacttcacgaagatattattgctctactttctgaactatcggagcaaacaggactttctaaaacccaaattgtcacacaaggaattaaactgtttgccgaaacaaaaaaggtcgcttagtgttaaatccgtttaaaatcagccactatttgagccaaytgattaggattaaaycgccagcccttttcgcttctgaatatggcrttaaaacaccattccgagcaaaaraatttacttttcttctcacgaaaaccyaatactaagccaaacacgccttgccaatcatagttagccccttttgtcttcttaaaataggctttsacttgttcttcagtgagattatcaagcggaattaaatcccatttttctgtcttaagkgtcatttctttttttcgcacaccrccatcacgaggrcttgaactgtagcaatcgtaggtgatatayggataataatcgccacttaaaaacgccgkttkytcwaccgcaatttcacaatggctatattgmcccttcgtgatgtgacgaataagcccatctgtaaatcggtcatagagrctaccgcctcgccccttgtacagagctaaatacaccttactcattgcyywrctccttmawrtastcsysataactggttgtccamccgycsgaataatcatattccgccggattgtccgattgstyyayrgcgkttttatgyttyaasgcattggcrtgattrcykgtyttrgcgtkcattaasgcttgccaaatcagcattaatttttctttgttaatcatcaatacagagttatccgcacaagtccaygcaatttccatatcaccgaataaatcataactggctttgacggataagatattccgctccgccgtagcgtccgtatcaatccacttgcccaccgcttccacaaacaccccgccattrattttttcatctcgcaaggcattgattttctctcgcatttccgcccgcacttgggttaaatgtgcggtttgattttcaggcgaaataacccactgccccttttcaatatgatgaaatggactgggttgcggttcggctaactgcggataaccgttttcatctgtgattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaagaattaacgcattttcctttttgttctaatgtaaaagcccttgttaatcatcgttacccctatcgttttagggttggcgattaccgagttttctttgaaattgccggcgatatgatgaatattatttccattgaagaggtgaaaaaacgagatgaacgcacttactaacattcaatatttacatgatgaaagcggacaccctgcttttgccgtcatgcccattgctacccttgaatggttaaaacaacaggcaaaactctcctctcctttagatagtggcgtgccttttgctgtagcgacttttgccttagaaaataattgctccgcacttgttgcgtggcgtgagcatttaggattaacgcaaaaagacatggcaagccgtttaaatattactcaatctgcatatagtcaatatgaaaaatcatctcacttgcgaaaagccacaagggaaaaatcgcccttgctttaggaattcatgcgacgcaattggatttttaattgtcattatttgtcctctttccaacgtccgataacaagccattctgacttacccaagtaccagttagtgataattgcttgggtatttgtatccgcggtcataaatatccagttatattgtccttcaccactcgctctatcttcgtatttttctgttatgaaacatcggtaatttttatccacaaaggcaattggaaataccacgtgatttttcacggtataaccttcacttttatgagtgaaaataccagtctgaatcatcgtaccatcaggatatttgcgtacctcaacatcaccgattttttgatagctaaactgagaggcaacggcactgttaaaatcggtaatttggctagctgtgtgcaaatgccctaaatccgatttgccctgcaacgctacagcgattttacttgcgtccatcattccagcattttccaccgcaccgaatgctttaatccaaaattgtacatcgtcaaaggtatttttggctttaatgcacaatttgagaacaagagacttaggacgagtttcttcggcacctgaatagaatattgctccgttagtgcggattttataattatccgcagttttattattcccagtagcaattgtgtcattattgtctacatggtactgataattacttgaattatggtttgtgccataatttaagtaatgcgttttaattgcatcctcttgtaccctccccacaaccagctcatttgctgcattacgcaaaaaacggtcttccgctttrggracrttktswatacygsyrtatttttyartyaggtatttatryaaytcagggtatktwtcttsykttacytyktcyytgatttyrtcaaackcaayccarccmtywggratatyrtctgtcgcaaaatacgccgtcataccgacatctgagcgagttaaattgggtaaagtgtttttatcgcctaaagtgcggtataaatccgggtaggtkckttggtcaatagtcgwyccatcgcattttaaaaagccrgtgggattwktaatwkctttcggaaacgcyacaatcgcccccaaaggcacaccatcaccgccsaymkmtttccaykcygtccayyytgarccrytaaaaaascgwgttttgackyykgtatcrttsgctttgcgtgcaatttgtcgcacggcggtagattgyccaccgctcaccacttcaacatgccaygcwccgttgttgtcgggcaaatkctgacygctcgcaaaataataatgcccgtckgttttgtaattatcgacatcgtccgaacctgytttaacctgaaaatcggtaatgccgtagccwgataaagtggtctgtttcgattgtttgctttcagcragttttcttgcgtcttccgctttgtcgtaggcagttttraccgcttttgatgtagcgacwgtatcggagctattgctatcsgttrmrtcsgatttttkgtttttwggratatattcctctagcttttttgctaactctttccccgctttagcggttaaggcgagtgtttcgctgtctgaggttgtctcgttggtcagttgcacaataccttgttggcttgtactcgctttggttatctcgtgagtatgtccgtcttcatcaattttattttgactgttgccattaatggttttgggttgtagctgtcccgttttcgcaaaaataacgttattatctatttttaattcaaaggcgtctgatgaggataccgccaaaattaagcggataatttggacttttccgctaccgcttgataattggggtttaaaactttcagggcaattggcataagcaactaatttatcgttattgtcgaataagccaatttctctaatccaaaaaccgccctctgtttcagggatcagtaattcaaagataacttgctgatgatttcttggatctaccgatattgcacttacattattgctataaactttgttttttaatgcggttgcgtttttatccggcgttaccgcttgtccgttgccgtcgccgattgccatttttaagagttgtaagggttttttgttggcaatggctgaggtaatgagctgttccccatgttgggttaatacggaataataggtttttgtcatttcttttccttatttggtttaattgggttatttaatttaatcgggttatggataaacactgataatttcgcccatatattgaccaataaaatgatgtaatggacatttaggcgatatagaaatagctaactgtgttaaatgtcttgataccggctttgcatcatcaacgagacggaccacttcattgtaggtttgttcattcaatccgctttcagcgacttcaatcgtaatgctgaatgtgcctggtgtgccttgtgggtgcagatcaaaccattctttgacttccaccaaatagccgataggctcaaccactcgacgaatagcactaatcgtacctttgtatttgtggattaaaaaagcctgttgaatggcaatacgtttgacttgttctgtccaatgctcatcccatctatctacactgaacgcccacgctaaatacggcaacagctcaacggggcaacgctgaggattgattaagtctgcaataataataggattgcggacagcaaactgtaacacttctgacgctttacgctccagctcgctactgcctaaaggcaatagtgcggggacggttgggaacctgtcatcaataatcatctgctgtcaccaattcaagtgtaattttttcacaaaagccggcttgattattctgtaatacaatatcggcttgaggttgtagtaattctacacgttgcaccccttcaatatgcaaggacgcataaataccggataaggtaatatctcgtcctaatcgctgtttgtcttcggtgtattttttgattttttcctgtgcctgtttgttgatgggttcgtattccggtcctctgtagatgtgcagttttgcatgaatttgataccgatgaatactggcactttgtaccgttactctatccgctattgggcggatattttcatcattcagttttttggtcaccgcatttaaaaccgcctcaccggcttgcccgtccccttttttggctaaaatagtgacagtcacattcgcaggtgagggcgatatcacagagacatcggcaacctccgcatgtgcggataacgcatggaatacataagctgcacgaggtcccgccacagacaacccctcaaacgctaattggcaacgcaaacgtaaatctgtgtcgctttctcgtttttcttctattggcggatttacgctatagtccgctttttgtatgatgagacgctgtacattaaaattagctgctatcacatcaagatcgctccctgttgcataagctaacattgttgcttttgctgcttcgttaatgcgtttgcgttctaataactgcaaataacaattttcttgtaataatttgttaatcggttcactttctaatgcgagtacggtttcccaataggcttgtttttctttagggtagagtgctataaattgagctttgcgttgttttaataactgttcaaaatcaaggtgttctaatacctttggggcgtctaatttcgataaattaactaattcgctcatgccgtttccctaatatgatttgattaaaatttatttttttgttgtcttttttgcggataaagtccatattggcggtgatttgtgctttctccggcacgatatccactttaaaacgtgtaatttcaattctcggctcccattttttcaaggcgatcactgacgccgtggcaagttgtaacatcagggcttttgtgatgggacggtcgatcagctcaaaaatataactgccatactctcggcgttgtattctcgtcccaatcggcgttaataaaatatccgtgatagattgttttaaatgggcgttttcgttttcgcaatatctgcctgtgtgtttatccattagttaggcactcctgtcgttccgccactgtcgccagcgtgtgtatgcgtttgtagcgatacaccaccggcggtaacatcgccttgtgcgttaatattgcctttaacacgtattgacccttgtacatcacttgagccttgcacactgcttgaccctttgatattgacgttaccgtctatattcatatcttgcgtacaatgcactaagggcgtgttaagcgttacgctgacattcgcttcaataagtgcggttttaataccgcttacttttaattcacttgtcgcttggttgtattggataatggcattatccgcaaattgaattacatgctcatcaggcgaattgctcggggtgttaaattccaacgtgtagagggcactcaaaataaaaccgctgtttatttcacccgcaggggaaataagaatacattgttcacccggtgtaattggcgaccaaattttggttgtaccggcacgtgaagcacaccacggcaaccaatccgttaagatattacctgtttgtactttggcacggcgtttttcgtggttcacttctgccacgacaccataccgcacaatattttctaattttcggttaaattctgcttgcattgcacattcgcacattcttaaataaagtgcattttgagaaatttaaccgtgtttgagtagtatgccgggttgttaagccggaaataacaaaaaataaaatacattaaagggcggatataatccgcccctacagtaggggcgaatcacattcgcccaatcacattcgccaaacaaaagtaagttgattaattgttattttagtaacaggttacatcgtcggagttgaagtcattcagtgaaagtcagccaatccaaacggtaggcattttcacgaaaatgtttaaccgttaaaatcaaaatttggttattgggttcgtcatgccaaaagagatagctataaccactttttctataagagacaaaaacctctcttacatttttcaaggtcttgccatctaccgacaaatcataggctttgccgttatttggtctatcttggctagcaacaaaagaattttttagcagttgcatgactgcatttgcttgctttgttgctcctacgtcagtcaaaaagttataaattcttgttaaatcagattgagcaagtcttgtgatgatgagctttacttgtgacatgggggcatatcctttggttcgtctgtttctagactgtccacccaatccataaactcacttagcgtaatatgcaatcctgtttcctgataatcttggtaggcttgtatagctcgtctatcataggcttgtttagcttttaagcgttcaatgtggctatctacggcatctaacacaatactgtgaacgctaccgccaaaatcttgggctaattcttgcaaaattgctttgcggtaacccagttttacgctggttacttcttgattggcaagcataattaatttcctttagaacaagagaacaagtagtcgctcatagtaatacaaaagtattactcgatcaatgaaaagtcttcggaaatatgaggtttattgcattgacatccgcccctgcctaacgtcggggcgaatcacattcgcccccaattaattaatctctgtctcttaaggcggatcgcatgcgtgcttgtttttgttgttctattttaactagggctttctccacttctcttgcaatatcttccgcacgttgtcccgccgtggcatgaatattgattgtcacttgcataggttgaggtgtttcttgcaggtgatgtgttgttggacttaagggcggtcgattatccataacaaaaggctgtgcggttgcaacgcttaatcccatgccggcggtcaacatggcttttttgccgtagttgagggcattgagcaacggtacgccaaggcgtgatgttgcctctttggtcataatatattctccgccgtgaaatatgcccataggctgatattttccaccgtttccggcatatccgcctgaccatttattcaccggcggaacgtgattggttgttgtttgtgtggtgaaggtggcttttgtgtcggtgtctatgccgattttttctttaaaccacccccatactgacgaacctacattgctaatagtgtcttttactttgccgagggcgtttactatgcctgaacttaatttttccatcagcaagctaccaacatcagagaaattggcgggcagttcaacaccaaaataatttaacacggcggaaaaagctttgtagaataatccgataggtgaccaatctataatcaacttgctcacgccgccaattccgccgttaaaggcttctttgatgtgttcccaaatgcctcccaaaaactgaaaaataccgttccatacgtggaaaacaatattttttatactttcccatacctcgctacaagccgtttttagccattgccagcctgcaacaagtgcagcaatgactttatcccagtttttccaaagtaaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattgaccttatttttgtgttaattgtcgcgtgtccttaccttatttgttatttttattttgatttaagcgttgggctgacatttatttttggcagtgttgctttattttttatttttgtgttgttttatgatacgtccaattgtgataaaaattgttgccactgcaaaaataagaatttagatgatgacatctaatcaatattttcactcaatgccttaatcacaaacgcttcaatcatttctttgtcctgttccgtaaagccgagcaattcacgcttggcgtattgtactttgtgttctttgtgtcgttctactcttgctcttaatccatattgatgaatagtggcgatgtaggcggtatttccgctaaaccctagttctataccgtctttttggcggcgtagcttcatgtgccttgcttgggtgatttttttaaacatggcttgggttttaattctgcctttttttgaccgcactttttgcttgcgtggttgataggctgaaccgtccggattttgctgtgctttaattcgtttgcgttgactgcgtgcgagttctcgtccgatttgttggtaaagcagtcttagccgttttggtgaaacgtttttaagcagacgttcaaaagcggtttttacctgtagcatttcatccatgttgtagctcttttatttttctgtctttttttctatgatttcttggtatttttgtgagcttggttcatctagatgtgtgatgatattttttccgttctcttcttttaccgatattcgttcggtgagttttaggaagatggatagatctatgctgtcgtggttgttgtgatcggcgataaagcggaatccgtcttttcttttgtccggattatggattaaatcaggttggttttctcggataaagtccataatcggggcaaaaatcatattgggcgatccgttaaaatcacgtacgataatatttaatgtgtattgcaattcataggaggaagatgtcgcaccggcactaacgacaaccccttcatcaatgaataattccaatttatcagggttggtattgaggtcttttgaggtgctttgtaacaaactgcggataagctctgcttttaacatgttcttttccttaactgattgacgagtatctataaatacgttggtgtttttcgataatgcgttgacaatctatacaacgacaatagccgttcttttggcgtatctccggtatttcttcttggcaatctagacagtatttcactgtgcttttttcccgtgttttttgttggtgtttttggatggcaagttgttgcattatttctgtgtattcgttggctctgtctacttgatcagtcatgttttttttcctgtaatgtgcggttgtagttttctatgcactgtgtaagtgcttgatttatcagcatacatttttctatttcattgagtgttttatccaaggcaacgacgagatctccgttattttttagtgttattgtcggtttttggcatagttgatctgtcgggcaaagtagcggtatcggctctattaatctgatgtgttcgttcgttgaacaggcggataatgcgattaggcacaggctgaccgctccagctctcatattgtaacgcttgtttaatttcatcagtccgtttctccgcttggtgtaaatgagttaagaggttgtcattcagtttttttacttgttcttgatagtggttgagttgtttttttgcatgatctaattgagcctttagttgtttggtcgtttccttttcttggttgaggatgttgtttgcgttgatgattttttgttcttttacttggttgttaaaatacaaatagccgttgatgctgataagtatagcaactgcaacgatgatgactttgtttaatgtggtgtttaaaaataatgcacggttaatcatggtattcacctaaacagagggctttttcttttgctctgcgtgctactaagccgtttaatttttttccgcctgcgtaaatccagcgttcaaactggtgacagagttgaggggtaaagccttggtttgcttgtttaaataaggtgcttttttgcatttttccacatcctacattaaaggtaatggaaacaaaggcatcaaacgccccttgcggtagatttttgccgtttccatagcggtttacgcattgttccgccaggcgtaaatcatatgcccatctttgggctatttctttgtcgctataacgttttttagggtcaatgttttttccgtttgcttccgtggagcctatgcccaccgttaagacgtcggcggggcagtgataggggtctcttctgcaaccttctacatttcctataaggtctaagccttgttgacttatgcgtaactcttgatggtttgctttgacaagggcaataatggcaactacgctacaaatagcccctgtcccccattttgtgaatttattcatggtcgccttcctttaagtcaatcttttgtttgagtgcggtttcttttaatttgatttctttgtttttgtaataccagttaatcagcatggtaaataagccaaataaaataccaaagatagctgcccagtctgccaaggtaaagccgctataaatggcgatggcagatccgacatacgcccctgttgtttcactattttttaacatgttaaacctcatttaatcccataaactcaatgtatttttgttggtggtggtttgtatatcttcactattaggcaagataacgacggtaccaatggcgaggattggtaagttggctaatgttgggtttagctccaatacgtgttctactaagccaagcgttttcccaaaataacgatagacaatgctatctagtgtgtcgttttgttttgcataaaccattcttgccattagattaactctactatcattctgtgttgtcctactatatcgcggatagcaaagcgtccgtcacgtcttaaatcatctacgctttgttcaaagtcctgtgctttttccgccccttgtttggtggtgtcgtatgagcgatagcgttcgtttaaattggctaaggcgaaacaatacaccgctcttttgtagcgttgtattacgatattttcgccgttgattttttcgtcatccatgtcttcaaggcgatgaatgtgtttttcttttagggttttttggtaatgttttaaggcgttgttagcggttgccatggcttcgataacttccattttcaaccgttcattcgttaccgttccgtctattcgcattgcatttcttacatcaagtaaatgaatatcagggaaaaagccgttgttttggattgtttcgttatctgttgcttgttcttccgcctgtcgttttaagtcgtccatggcgtaatttttgacttttttgatggcgatgctgttatacatgatgttcctttaactgtaaaaaagcgaggtgaggaaagtgatgaggcaaaaaacctttactttccgcctcgcttggcttgggctaggttgctctgtttcgtgttcagcggggattttcttgcgttaattgttttcgcaatttttttacatctccttgaacgccaatatttaaattcagttctaatgccttttccaagtaggctaaggcggtttgcggtgctgatgtgagctttaatagtccgatttctctataaagcctcgctctactttcatccggtatatcttggtcatcagtgaggttcgctactcgttctaaataagccacgtcaaaagggcggttaagtttttgtgcaattttggctttatcggcaaattcttccgctagggcagaacataaggtgcggttaaagttttcgggcaatactaatccttgatgtatagcatagtcggcaatttgtaatgcgaggtgatattgctcacagtctattaaccaaattagccatgtcattaagacgttatcttgtttgccacttgcactacttaacgctccctctatccaaggtaaataatccggtaaaatgttctttttgtagtccgcttttaacgccatagaatgaatttgttttaaatcctttttatggcgtgcaagaagatacaacattctttcgtattccgtcgcttcgctaagtatgcgttcttcttgcatatgtgcctttttcgctgaaacttctagaaaatgccttcttgttggacgcattcacgctttccttattcagcttttttcgctttgatgtcttcaggggcgtctatcatgttgatattttttaacaatgccacactttcatagttttcgacgacaaagtcatcattagaagaggtgtaatcttcatagcggtcatattctgcattatcttttaatgttcgacgcattgccccttcttggtaatagattgacaggttatcaagtcgggtaattaagatggtgccttttggtacaaaaggggcttgaacggcttgtaatccgcctactcgttttgtactcataataatatcaccggcaacttgttcactcgccttgctttgattgagcagagggaagtatttatcagccagcaaatcacggctcataatggcgactaatttcgtgtcatcttggaattgaggtgcgattaaatcgctgacagcagaaaacacaagggcatctaaatttttgtatgtttttccttccccgacttcaatttttccgctggactttttgtcttctgtcatgacacgttcaggtgcattgtcttcaatttttttcaaccagcctacagcgacatcttgtaataatgggtttgttgctctattagaggttgctgcacgacttgttccgttaaaaccgatcataattctatccagtgccatgcgttcggcttttaatgtgccgatgcgtttagcgaaatcagggaattttgcccacatatccaagatggcatatttgagatgtgtatcatagttaatttgttggcagtgatacggaattttgtttaacgcatgaatggcttgcgttttacgtcctgtcgcattggtatctgttgttcctgcaatggtacctgatacgcctaaccctaagatttcaccttgttgttcatctaccggtacaatgttgatcagttttaggaaatccgagctttcttgtactgcattttcaagacgttgctgtacacttggcgtcacattaaatttcgcccctcttgcaattcttgagaaatcctcttggttatcgtttgaaataccttgaatgtaattcattaatgtttgtgcggtggtttttttcatcgtgtttaagtcctgataattgattaaaagaaacgtccatcattcatactatcgccactaattaaagggcgttcggtatagttggtatgcggttttttttccaacgtggtaaatttttcgctgtgttcgtttgttttttccgtgtattcatttagcgtttgttttagcgtttgattttccgtttcaagtgcggtggttttttgatggagatgttgtacttcttttgaaagtaacatgaccgcttgatctacatcgctaaaacgttgctgatccgtccgctctttttggctaaacatggcagtaatacgttcaaataaacttggcttttccggctccacgtcgttaaattcaaatacggtttctattgcctcggtaaacaaatttcctgtttttaatttgcgtgcattaaatggattggcttttgctgttgcagcaaactgtaacatttcggtccctaaacttgccgggttatccgttactgcaagacctactaaataggcttttcccgtgtcgctgaaattgatatcgatttcaattgaggtatacactttttgacgttttttgtttaacgcaatgagttcttctgtggggtcaatttgtgctaagagttgtaattttccttcgctttcttgggtttttaatgcgatgacatcaccataacattttgcgtgcggttcttcttctcggtaaagataagatttgatgtgatctaaattaatacgtgctccataggttttaggattgtagctttccgccatttgttcaatccaaactcgtgaaatattacgtccgtctgtggtcgccccctcggttgcaacaacaaaccattttgatttgtattttttcatgggtgtattcctattttttcttttcaatttgtttttatactggttgatttcttttttcttgtcatttgcttatcaatgttaatttttttttgacagtttacaggggtcatgcattttcttggatttccttattatgctgtgagtgagaattaaggatggatagatgattgatataacgttagacagtaagcgtgaaagccgattactttatttttccggctggcggattacggatattgccgacaaattaggggtgcctatttccacgatttcaagttggaaagacagggagaagtgggatgatatcgcccctgtcggtcgggttgaaaataccttagaggcgagattgaatttacttattttaaaagaagataaaaccggtcaggattttaaagaaattgatttgctgggtcgtcaaatggaaaaaatggcaagaattaagaaatatgccaacggtggcggtaatgaggttgatttaaaccctataaaagctcaagcgtttacctaggcaaacaaaatagaaatggaaataatggaaaatttataccaagatgtagctaacataccatttgagcacgtgatcgacagatacctaaacgaagtaacatcacaaaaaagtaggagtagagtgttccgaaataatcacatcatcattgattacttttaccgatattttttattcaccttaattattctacttttcaaaagattgtttataaaagaaagcctgttttcacaggcttcctatttatctcattagaatgttagctctgcactaagtttgaagttacgtcccggggcattgaagcggtttaaacctttgccggtgacgtaatcaattttattgcttgtaccaaattgtctaattgaacgagcagaatcccaagtgacatatttacgattagtgagattataaacaccaaattgtaagatcaaatttttgattggtttggcataagcgattacatcaaccaaagtgtaagcatcacttctccatctaatagagctgtcagtggtaacattagtattaccgatgttggtaggattagttattttttcttcattttgtgtttctctccacgtatcattatatgtatcagatgcttttttagcggcaacacgagttacatataaatccacaccaaatttaccatttgtattatgataacttagcccataaatgcttgtttttggctgaatagcattcattggagcggtaatattaataaattcatttgggtttgcagggtttaaatactctttaacttttactcgccctttttgcttactaaatttataactaaactcaaattcacttaaggctttatgcaaaatgctcaaatttaaacgagcgttaatctcaatcccactcgatttagcggattctctgtttatattttgtctaatttcatatggagttttaccaccatttgaatttttgtgatatccaatcgttctagcaaaatcaatgaagtttttatatttcgtttcaaaataattgaaggtaataaagccgaaatctttatagaaagttagtgcgatttgattcgttttagctaactctggttttaattgaatattaggtacaacatgcaaggtatctccatatttagggttaaaatcccccattttaaatgcgaaatatatttcatcggatgttggtactctaaagccttttgagtgtttaaattgtaatcgcataaaattaaaaggatctgtatttacacccaaagaataagaatgtgcagcaaaacttttttctttaacaaaagcatcaatatttgcctgatgacgagctaatttatttttctctgcgatttttttattttgtacaacagcttcattgtatgctactacagaatcatcatatttacttttttccttattatattcatttactttctgataaccataatccgaaaacttaggttcaggtaatttttttggtagctcgactggtttatatggatctttaaaatcatgagcgaatccaccgacaatatcatctggaatttttggggtgacaccggcagtatagctaggctgatatttaatttgatcataacgatagcccaactcgaaactaatacgatcattcaatttaaaatcatccgcaaaataaagggcccttgaagttgctttaacaggaactaagaaagagaaaatattgcttttaccacatagactagaataacttgttttacaattctctggatacaatgcccaccatttgacattgatagctgaatcgcccgattgattaaccatttctttttgggatttagacaaagagccaccgtaacttatattgtgatccgttttccctaatataagatattttgtgaaatctaaattaaattgtttggtgtttgtgttcaaagagcggtctgtccaaagattggtgttatgccccttagatgaaggtaaaaataatctatctgaatgtaatgcctcaccaccgatttttaatatcgctaagttacgctctttatctactttaaatcccaatcttttgggctgattgtgttcatcaataacggctattgtcgagtcaccatctctatctttgtctttggtatcacaactaatgccatcacaagataataaaagaggtgaatttgtttggtatttctcaatccacttactgttttccttgagagttaagtcagaataaacttgaccatttgaaattaattgctccgtaattattgttgcatatataggtatcctacacttatcagggtgttcagaagagatatctttataacaacttgttacactagtaggaacatcctttaaaactcctaatttttcatatttctcttttatatcatcaggtatcttctcgttccaagtatcaaatacatcttgactaacatattcataataagtttgtttctgatttgaatatttatatgtaataggatttccatctttatcaactagttcattatttttgttgtatttaattcccaatgggtttaatgagctattacatttatcattcccatcacaataatcttcatttctagctcttgttttaattttttgctcagaataagtaaatttcatcgtatcccataaaggattgctagaataattttcataagagaatgcatagttggttcgttttacctgatcattattatgacgatattcaagttcgggaggatcatttgatttttggagaccggttgcttttaatgtataggaaagatctgctcctttagagcgactatcatataaatcggcggtaacagtaaagcgatgattttctgtgggttgaaaagataattttagtaatgtactgtctaaatgtttgtgataaggatctgctttttctcttcttttaccttgtactgcagcatcaaaatggttataaccatagttctgtagttcatgaccatcacgttttgttttcactaataaggcatcaaaccatttataacgaccggctaaagtcatggaatctatatgctgacgatccgcactgttgtaaccttttttgtaagaaacataccagtttttctctgtgagaaaatctctagcgtctttagttttaaaaatgacagcaccacctaatgcaccgctgccaactttgagtgaattggctcctttagcaagttgcacttgtttcagagtttcaacttccgctccatttctcgtattattaaaattaccatagccttcaaataattctttaaagccctgagaactcaacgtttccgcttggtgtaaaccatctatcgtaatggctactcggttttcatcaacacctctcattgcatagccactggtaccaaagcgtcctttctctacagcagtgattcccgtttcataacgcactaaatcacgagcatcctgcacttgttgacgttttagttgttttgcacttttaattgtttcgccgacctttttttgttgtatatcttggtcatctaaatctgatacaactttaatctcacctaactccgtgatagttgaattagtttgagcctgagaggggggggaagtaagccgtaaacggacaataccattgtggctgcgatagagatttttattttatgaggtgcatgaatttcaaacatatttccgccttgcactaaaaattaagtattttgatgaccttcaaccaaatgaacgaagcttactaaatcttcattacttacttggaaagcctgaccaaaaccttttacaaataaaccttgaatcggtttaaaactaaataaataaaaatccttataagtactaatttcatcaattaatgcaccatggcgttctctaagaacagcaatacttgctttccattcttcggtttcacgttcaatcacacgagatgtagcatcaaaagataaacgacggcgagcaaaaatctcacgacttttactttcgtcttcaataagcattaaggaaactttaggtacttcctgtaaattacgtgcgtgacgggcaatagttgaaataaaaacctgatattctccattagaaatggcgaatggggcatagctcacattaggtgtaccatcttgtccaacggtggctaacataatggttttgcttagtgcctttaattcttgaatttctggacctaatcgattttgtaatacttcttgacggtttgttgctgtcattttgatttcctcgttaattaaataaattgcttaaatttttctacttggtgcgggaataactgacgttgttcatcacgaccaagatagaccttaaaaatggtttgtccgttgttagcaataaaggcaatgttgtaactttctttgcctctaaatggcaaactgacaaatgcgatttgggcaagattgccgagtttcacatgaccatgtagtgtgccttcatcatctttcatgttgaggttataataaccacgaccaaccatacctgtaggaaaacgatctttaatttcaaaaatcgaaccctctttttcaataatggttgtaaaagttccccatttgctaatttcagtcataatttccaccgctctttcagcagagaaaattcgcacaaattcctcaggtaatgcacaaagaatattgccttccggttgctgaaaatgttccgccatctcaagcgtgatagaaagagggttttgagcaatgtaatctgcgatttgctgttttaatgtgtgcatataagttttacttaaattagaaatttaatttcataattgataattattcttaattgtatttgaatttatctactttgaaaagaggggagaagtggagttgaatcgataattattataattttttaatttaacgttttttagatacttgaagtctaaaataacaaccttatattgtgaaaactgctacaagaattaaaaaattatgggaaagaaaaaacgttcagcaagctccagccgttggttaaatgagcattttaaagatccttttgtgcaaaaggcacataagcaaaaacttcgttcaagagcttattttaaattggatgaaattcagcaatcagatcgtttatttaaacatggtatgacggttgttgatcttggtgctgcaccgggaggttggtcgcaatatgctattagacaaattggagatctggggcgagtaattgcttgtgatattttggaaatggatccaatcgtcggtgttgattttttacagggcgatttccgtgatgaaaatgtattacaggctttattggagcgtgtcggtgagaaaaaagtagatgtggttatgtctgatatggcaccaaattttagcggtatgccagcggtagatattcctagagcaatgtatttagttgaacttgcccttgatatgtgtaaacaagttttagcaacaaatggatgttttgtcgttaaagtttttcaaggagaagggtttgatgactatttaaaggaaattcgatcattatttaacacagttaaagtacgtaaacctgaggcatcacgtggacgatcccgtgaggtatatatcgtagctatgggttatatgggatagaaataactggtctgttgtcttattaataaataatagccaattaatctgataactttaaatccaaatagatttatagtatcttatgaaaaatttttaattactgaaatatggagttcaaaccttgaacgatatggtgaaaaatatagtcctttggatcgtagtcgctgtcgtcatgatgacagcctatcagagttttagtggaaactcatcaaataacgcaattgattacaccacttttattagcgatgtagaaaataaccaagtttcagccactaaatttaatgaggtcggtgaaatttttgtaactaaaaaagatggttcaaaatatacgacagttcttcctacaccgttagaagatcgtaagttattagatgatctgattaaatcaaaggtgaaaattgatggtgctttgcctgagcaacggggatttttatcgcaaattttaatttcttggtttccaatgatcttattaattggcgtttggttcttttttatgcgtcaaatgcaaggcggtggcggcaaagcaatgagttttggtaaaagtcgtgccaaaatgctaacgaaagaacaaattaaaactacttttgccgatgttgcaggctgtgatgaggctaaagaagaagtcggtgaaatcgttgatttcttacgtgatccaagcaaattccaaaagttaggtggtaaaattccaaaaggaattttaatggttggacctcccggtacaggtaaaaccttattagcaaaagctatcgccggtgaagcacaagtaccattttttacgatttcaggatctgatttcgtagaaatgtttgttggtgtaggtgcttcccgtgtccgtgatatgtttgaacaagcgaagaaaaatgcaccttgtttgatttttattgatgagattgatgcggtcggtcgtcaacgtggtgcaggtcttggaggagggcatgatgaacgtgaacaaaccttgaaccaaatgcttgttgagatggatggctttgaaggcaacgaaggtgtaatagtgattgcggcaacgaaccgccctgacgtacttgatcctgcgttgactcgtccaggacgatttgaccgtcaagtcgttgttggattgccggatgtacgtggtcgtgagcatattttaaaagttcatatgcgaaaagtgcctgtggcggatgatgttgatgcaatgacattagctcgtggtacaccgggatattcaggtgcggatttagctaatcttgtgaatgaagccgcactatttgccgcacgtactaataagaaattggttaccatgttagagtttgaaaaagcaaaagataaaattaacatgggaccagaacgccgttctatgattatgaccgataaagtgaaagagagtaccgcttatcacgaagcagggcatgcaatcgttggttacttagtacctgaacatgatcccgtacataaagtgactattattcctcgaggacgtgctttaggcgtaactttctttttaccggaaggggatcaagtcagtattagtcaaaagcaactagaaagtaagctttctacgttatatgcgggtcgtttagctgaggagcttatttacggtgaagaaaatatttcaaccggtgcttccaatgacattaaagtggcaaccaacattgctcgtaatatggtaactcaatggggtttttcagataaattgggaccgattttatattcagaagatgaaggcgaagtgtttctaggtcggtcaatggcgaaagctaaacatatgtctgatgaaaccgcacatacgatagatgaagaagtaagatcaatagtgaatcgtaattatcaaagagcaagacaaattctgattgataatatggatattttgcatgcaatgaaagatgctttagtaaaatatgaaaccattgaagaagatcaaattaggcaattaatgaatagagaaccggttgttgctcctgcaggttggactaataatgagtaaaatttatttgtagttttggcaacgtttagtaaaatgttccgactatgtcgtaggttctgattttttaataagggaaaggggttgaaagtcggtaatgtaacagaagtaaccccaaacaattattctttattttgggtagagtatgactttgggattttgttacgagacggcggaagaacagttaagaatattgaaaaaaacataataataggggcgatctactatagcccctatttttattgcaatttagataaagtttattttttatcgttactgagttttttattgaaaaataaatgtgattaaaaaatataaagactgagagtatagttatgaaaaaaatttttttaaaagaattacaaatgatttctttagatattttggattattttcatcatatatgtgaagcacataatatacagtattcactgggggggggaactttgattggtgcaattaggcatcaaggttttattccttgggacgatgatattgatgtatatatgctgtggagtgaataccaaaaatttgtctcagtttggaataaattatcacataatttctataaaatatctcctattgaaacttttgatggggatgttgtgggggaaatggctaaaatttatgatgagagaacttatttatcagaaaaacatagggcaagtcatatatttatagatatttttattttagattatgtgcctagtgatttaggtattttgtataaatctatgaagaagcatcgtagattaacacttaggtttaagtctttaaggaaacgtttttatcgagctaaagataagagtggttgtaaaaaaatatttggtaaattatcacaaatttattatgaaaaaatgcaagctaatctcagtcgattaagagaaacgtacaatgaaaaaaacagtgataatatcggtctttttttatctgactatgcttgctggaaaaaatcttatatgcctaaagaatattttcggtcgtttaaaaaagttaagtttgagaataaatatttttatgtaacggaatattatcatcagcacttaacagattattacggtgattatatgacattaccgccggaagatgaaagatctcctaagcatggaatagaagtatattggaaagagtgaggttacaaaattttatggcttatttttttatctaaattaacagcaaacaataaaacaatagataacttagagaaacaaaatgttgtaagttagattaattgaaggactggattttgtatgttaaatagacccagtccttttagtttgatacaaataatatttgtaataaatttctgtaatttttattttttaaagataatgtagatctgaaataacatgtgtaatgctattaaaaggttagtggggtgatacattttttagttaattgaaaaagtatcaccttcgtccattagattttagcccgatttttaggtatagccagtaaaattggtcatgtttcctattattaaaatttcattgaaatactcatcttaacattacgtccaacacctgaaactttttcacttagataagggttgtacttgcgattaaagatattgtctatgcttagagaaagcttcattccgtgtattttcttaggttcccatatggcaaatagatgatgtaatgagtagccactggatttaggaagtgaccaataccccgcatccggatcattatcaataggtgatctatcttgtcgacggaaaaactcaccttgccaaccaattgatatattccatttgggtaggtttgtacctaatgtcattattgccttacgaggagggatctctgctatccaatctttgcttctagattaactaaaggatgatctgatatgtaagcccagtctagagagacactttcgtcagtcagtttgcgatataccagtttccttttccaagcaatatcttctccccatttctttatgtcggatatacttggtgagggtaaattatcacgcatagcggcaaacggtgtccaaccggagttattggagcgtacagctgaaagcgtaaatttttgcttatctgaaggataaaaattgacttttaataaatagctcttattgtcattttcagagtataagaaacgagatccgtcagggcgttttatgttttgactattacgaacggtcgtgtaaaataagccctccagattttttgcttgattgcgtagaaaaattgcaccgctccaaatattctgtttatcattcgtatggtaactatatttagcaaatccacctatattttgattttcattgagaaaatcgctcggatttttagttataaattttaaggtttcaccaaatccgctattcccatattttgtagaaaagcttcctttatcaacctccacccgacgcagtaattccggttctataaatacagatccttgacgatatctttcaaagtttttttgtatcccgtctaattcaatacggacatcttcactatcaccaaatccccaatattgatattttgacctcccggtctaggtgaacctgacatattgacaccaggcaaaacattaactaaggctgcggcattgtcagcttgctgtcggtcaatattttttgttaatagtgttgaacgtccgatatcatactgttcattttgaactaagatgacaggaagagcgtcgtattgttgagcgattaatttgcttgtataaaacgtagatgaaagcaatatagtgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtatgaaggggggggaatttaacaaatttattgcacatgactatcgtaattaatgtaaataattgggaatataactaattatcattttaatgtaaagatttttatccgagagaataaaaaagaatatgaattgcataaacattcaatatagagttcaaaggtaagctactttgggcgtttttcagtgttttattcattatttttgtatttattctcaaaaatttttttatttttgttcattccaatattccgctataattgaccgcacttttaacttgattgcgtagcagagcaaatgaaattacaagcaaacaataaaactttggatcttactttacctaaaatcatgggaattttaaattttacccctgattcattttctgatagcggacaattcttttctttagataaagccttatttcaggctgaaaaaatgctgtcagctggtgcttcaattattgatattggtggtgaatccactcgtcctaatgcggcagaagtaagtttggagcaagaattggatcgtgttgtgcctttagttgaagctgtaagaaaacgttttgattgttggatttcagtagatacctctaaagctgaagtaatgttggaaagtgctaaagtcggtatggatataatcaatgatattcgtgcattacaagagcctaatgccttagagacagcggtaaaattagggttaccgacttgtattatgcatatgcaagggcaacctcgtacaatgcaacaaaatccccaatataataatgtagtgcaggaagtattggaatttttacaaaatcacaccgcactttgtttacaagcgggcatgaaaaaagaaaatattatttgggatcccggtttaggttttggtaaaactgtgcaacagaattataaattattacagcaagttgcccgattttgtcagcaggatattcctgttttagtggggttatcacgtaagtctatgattggtgcggtgttggataaacctgtaggccagagagtaataggtagtgcgacaggtgcattacttgcggcaatgaacggtgcaaaaattttgcgtgtacatgatgttgatgaaacattagaggcattgaaaatttggcaagcaacagaacaggcttagttttaaagagttgttctacaataagttgatttcacagagtgaaggataattttgcttctcttgcgttgatgaataatcaaggaacgaaaaatggcggaacgtaaatattttggaactgatggtgtgcgtggcaaagtaggaagttatcctattactcccgattttgtgcttaaattaggatgggcagcaggtaaagtgctagctacacaaggaactggtaaagtcctaattggtaaagatacacgtatttccggatatatgttggaatctgcattagaagccggattggcggctgcaggactatctgccgcatttaccggaccaatgccaacaccggcaattgcttatttaacacgtacttttcgttcggaggcgggaattgttatttctgcttcacataatcctttttatgacaatggaattaagtttttttctgcacaaggtacaaaattacctgatgatgtggaagaagcaatagaggctatgttggaacagcctatggattgtgttgaatcagctaaattggggcgtgcaagccgtattaatgatgcggcaggtcgttatattgagttttgtaaaagtacttttccggcacatttaagtttagataagtataaaatcgtggtggactgtgcaaatggtgcaacttaccatattgcaccgaatgtcatgcgtgaacttggtgcagaagttattgaaattggtacgcaacccgatggtatgaatatcaatgaaaactgcggtgcaacagatatcaaagcattacaaaataaagtattggaaacaaaagctgatatcggtttagcctatgatggcgatggtgatcgcttaattatggttgatcattttggtaataaagttgatggcgatcagatcttgtttattattgctcgtgaggcgttacgttcaggtaacttaaaaggtggcgtggtgggcacgttaatgagcaatatgagcttagagctcgctttaaagcaattaggaattccatttgttcgtgcaaatgtaggtgaccgctatgtgttagaaaaaatgcaagaatataattggattttaggtggtgaaaattcaggtcatattattattgcggataaaaatactaccggagacggtgtgatcgcttccttggcggtattagctgcaatggtgcaacataaattgtctttaaacgaattagcaagtgcggtgaaattatttccacaagtgttaattaatgtacgttttgcaggtggtgcaaatccattggaaagtgatgcagtaaaagcagttgcaacagaggtcgaaaaacaacttgcaggcaagggcagaattttattacgcaaatccggaacggagccattaattagagtgatggtggaatgtgaggatgctgaactggcacagctcagtgcagaaaaaattgctgaggcagttagatctaattaggtgtaataggataatgaaaatatttgtaatgcgacatggcgaagcagaagtgatggctaattcggataaagaacgccgtttaacctctcgaggtcggttgcaagttagcgaacgaggttattggttaaaaacggttattcctgattttgataaggttttggtaagtccttatagaagagcggtagaaagttttgaaaaaatcgatgaggcttatcatcatcaactaagttcaaaacaggaaatttgggaaggtattacaccttatggaagtagtcatttggtgatagattatttatccgtattggcaaataaaggtgttgataaggtcttgattgtttcacatttacctttagtgtgggatattgtcacagaattgtgttctaaacgtagccctatcagtttttatccctctacaattgttggtttacagtgggattgtgagcaaagtgcggtcattacggagataaaatatccggagtagtaatatgcaaaataacgatttcttatccgcctttattttttcaaccagcgttactctgccgacattgttaatgctgatgttgggtgttacgttacgagcaaaacgagtcattgatgatcgtttcagcggacaagcgactaaaattatttttaatattaccctgcctgttttattatttttaagtatttttaaaaatcctgtggattatagccaacaagtgcctcttttattggcaggagtggttggtacattaattttatttgttggtgctgagatttttgccgcaaaatttgttgtcgataaacgtgaaagaggcacttttgtgcaaagtgtttatcgaggtaataacggcattttaggtttagcattttgcattaatgcttatggggatttagcgttggcaccggcgtcaatttatgcggctgcattaacttttttatataatattttaggtgttattacgctaagtcgttctttatccgatggtaaagtcggtgtcaaaaaaattgttttcaatgttttaaaaaatccattaattattggtatcttactcggtattttggcaagttttaatcaggtggtttttccaaaagcaatcttgacgaccgctgattatcttgcgagcatgaccttacctttagcattaatttgtaccggtgccagtattgatgtgaaaggattatttaagattaatgcggtatctttatgggcgagtatcggacgattactggtcgcacctatttttatggtagtgattggcaaagttttaggtatcaccggtatacatttaggtatcgtgttattgatgtcttcaacacctttagcaactgcggcttatgccatgatcagaggaatgggaggcaatgctgtaacagctgcgaatattattgggttgacaacttttggatctatgtttagttctgttacaagtctgttattactgaatcaaataggctggatttaaataattttttcgtttttatttgattttgttattattcggtaacgtttatatagtgaatctattttttggcaaaatataaccgcactttggacttatctataaaagtgcggtttaaatttataaatcaatgcaacaaatcattcaaacattttccgacaacggcgtattaagtaaaaatatcaacggtttttgtcctcgagttgaacaaacggaaatggcaaaagctgtagggcgggcaattagtcaaaaaagtactttagttgtggaagctggtacaggaacgggaaaaacatttgcgtatttagtcccggcgttattggcaaaaaagaaaacgattatttccacaggttcaaagaatttacaagatcaactttttagtcgagatctccccactataaaaaaagccttgaactatagcggtaaaattgccttattaaaaggacgagccaattatttatgtttggaacgcttggaacaagttattgctcaaggcgttttggggaatagagaagtgttggcggatttggcaagcgtacgtcgctggaataatgcaacaaaaacgggcgatttaactgaatgtgttgaacttgcggaagatagccctattttaccgcaactgaccagtacggcagaaagttgtttaggggcagagtgtcctcattatgcagattgttatattgcccttgcacgcaaaaaagcacttaatgctgatttagttgtagtcaaccatcatttattttttgccgatatagtcgtgaaagaaagtggttttggtgaattaattccgcaagctgaagtgattatttttgatgaagcacatcaacttcccgacattgcaagtcaatatttcggtcaaagcattacttctcgccaattttttgatttatgtaaagatattaatattgtttatcgaactgaaataaaagatatggcacagcttggtgtagcttccgacacgctgttaaaagcggtgcaagactttcgtttattgctgggtgaagggaatttaagaggcaattggcgtgaagttttacgccaaagtgcggtagaaaaatcgttcagtttgttacaagaaaaagtggattttacagcggaagttatcaaattagggttaggacgttcacaaacgttagacagtatttttgagcgtattattcagctgaaagcaatgcttcaacgcttacaagcaacaaatatcgtaggattttgttattggtatgaaaccatgggaaggcaattcggtttacatattacacctttaaccgttgccgataaatttggtgaacaaatgaaagctaaagaagtcgcttggatttttacctcggcaactttagaggtggcaggaacgtttgctcatttctgcaaacgcttaggtattgaaaaggcggaacagcaagttttacccagcccatttaattttaccgaacaagcactattttgtgtacctcgttatttacccgtcaccaatcatcgtaacacattaaatcaattggctgaaatgttattgccggtgattgaaagtaataatggatgttgttttgtcctttgtacttcttatttgatgatgaaaggattagctgagtattttcgtgaacatagtcaattaagtgttctgcttcaaggggaaacttctaaaggaaaactgttagagcaattcattaaagaagatcattctgttttggtggcaacgtcgagtttttgggagggagttgatgtgcgtggaaaagctttatctttagtgattattgataagttaccttttactgcaccggatgaacctttacttaaagcaagaattgaagattgtcgtttacaaggtggagaccctttcaatgatattcaaattccggaagcggtcattgccctgaaacaaggtgttggtcgtttaattcgagatgttactgatcgaggtgcggtgattatttgtgatagtcggttggtttttcgaccttatggtgaattatttttacatagcttgcctaacgcaaaacgtacccgagatttaaacaaggtggtacaatttttggctcaaattaaaaaggagaaataacagaatgatgacaactttattagcacttgatacatcaacagaagcctgttcagtcgcacttttatacaaaggagaagtcacctattttgatgagttggcacaacgcactcatgctaaacgcattttaccaatgatcgatgagattttggtgcagtccggtattcaactaaatcaattagatgccttggtatttgggcgtggaccaggaagttttaccggtgtacgtgttggtgcggggattgtgcaaggcttagcttttggggcggatttgcctgtgattcctatttctaatttaaccgcaatggcacaacaggcttatgagcaatatggagcggaacaagttttgtgtgcaattgatgccagaatgaacgaagtttattttagtcaattacaggcagaaaaagtgcggttggaaaatactgattttgttcaatggcaagagttagtcaacgaacaagtttgttcgccacagcaggccttagctcaattaaaagatatccagattgaagattggacaatggtcggtaccggttgggaatatgctgaattcaccgtagcgggattgagtgagaagacgcaaattgatttaccatctgcccgttatatgctttctctggctttgccttcttatcatcaaaaacactggataagtgcggtagaagttgagcctgtttatttgcgtaatgaagtaacttggaagaaacttccaggacgtgaataattcatgatgtgtttatttttctattgctcgtgtacttgctgaattttattttgaagaaaatcttgatttataggagaagattgaaagatgttttattgcattgaggtttttgctaagagaaataaatctgctcaaaataaaaaattgaagtataatgcacccgatttttcacagaaaaatagtaaaaatgatagaaatatcagttaattaaagaggataaataccatgcaaaaaccttggtttcaaaattaccctgagggctcaccgctggaactggacacttcaaaatatgaaagtttgttagacatgtttgataaagctattcgtgagcatcctgatcgtccggcttatgtaaatatggggcaggttttaactttccgtaaattagaagaacgtagtcgagcttttgctgcttatttacaaaatgaactaaaattaaagcgaggtgagcgtgttgctttaatgatgccgaatttattgcaatatcccattgcgttatttggaactttgcgtgcaggtttggttgtggtcaatgttaatccgctttatacaccgagagaactggagcatcaattacaggatagcggtgcaacagcaattgttgtggtatcaaattttgcgtcaactttagaaaaagtcgtttttaatacgaatatcaagcacgtcatcctcactagaatgggggatcaactctcttttggtaaacgtactgtggtcaattttgtagtgaaatatattaagaaattggtgccaaaatataagttaccgagtgcggtaacatttcgtgaagttttggctgtcggtaaaaatcgtcaatatgtacgtccacaagtggaacgcactgacttagcttttttacaatatacaggcggcacaacaggtgtggcaaaaggtgcaatgttgacacatggcaatattattacaaatatttttcaagcggcttggattgcctcaccctttgtaggcgatcataaaaaacagcgtaaagccattatagctttaccgctttatcatatatttgcattaacagcaaactgtttactttttattgaattaggtattaccgcagttttaattactaatcctcgtgatattgacggtttcattaaagaattaaaaaaacatcgttttgtagggataactggggtgaatactttatttaatgccttgctgaataacgaaaactttaaagaggttgatttttccgcattgaagttgtctgtgggaggcggtatggctatccaacaatctgtagcgactcgttggcatgaattgactggttgcaatattattgaaggctatggaatgacagaatgttcgcctttaattgcagcatgcccaatcaatgtagttaaacataatggaactattggtgttccagtaccgaatacagatattaaaattgtcaaagatgacggttctttagctgaacttgatgaacctggagaactttgggttaaaggtgagcaggtaatgcaagggtattggcaacgtccagaggcaacggaagaagtgttaaaagacggttggctggcaacgggtgatatcgttattatggataaaacttatagtttacgcatagtagatcgtaaaaaagacattattattgtatctggttttaatgtttatccgaatgagattgaagatgttgtaatgcttaatcctaaagtagcggaagttgttgctattggtattccggatgaagtttcaggtgaaaaaatcaaaatttttgttgtgaaaaaagatgatagtttaactcgtgatgaaatacgccagcattgtcgtcaatatcttacagggtacaaaattccgaaatatattgaatttcgtgatgaattaccgaaaagtaatgtaggtaaaattttgcgtcgagtattacgtgatgaagagctggcaaaacatgcgtaaaaataaatatcaagtgggcgattaaacgcccactttttgtgtatcgttttacccacaatgatgtagccatgagaaaggttattgaataatagataattagcaagtatgtccgttttaataaaagaaatccaaaattcaccgcagtttcaattgattactacaaatgatcgtttatatgagatttgccaacaggcacaacaaaaaacggtgattgctttggatactgagtttgttcgcaccaaaagtttttatcccaaactaggattgattcaactttatgacggtgagcaagtgagcttaatagatccttttgagttgagtgatttttctccttttattcaacttttagccaatcaaaaggtcacaaaagtattgcacgcttgcagtgaggatctggaagtttttcaacattattttcagcagttgccaacgccaatgttagatactcaaattatggcggcatttttgcaacatggcaattccattggtttagctacattgctaaaacattatttcaagctggaaatagataaagggatttctcgcactaattggcttgctcgccctttgtctgacgtacaattgcactatgctgctgccgatgtatggtatttattgccattatgtcaacgtatgcaacaaaaattagctcaaacctcttggcaaagtgcggtgcaaaatgattgtgaaaatttgttgaaaaaatatactcagataaaagatagtgacaatgcttatttttctatatccggagcgtggaaattaaactctcaggaattaatgcgtttaaagctgttagcaaaatggagacaagaagaagcgataaagcgtaatcttgcattaaattttgttgttcgtgcagagcatttgattttattagcacaacataatccaaaatatacttcacagctgttatccattggtttatctccgctggaagtgcgtattcatggtaaaaaaatattacaactcttagagaaagcaaacaaagcaccggcgtatgactatccaccaccaattttgcgagtcactgatgatcatcgttatcgtgtagcaattaaattgttacaagcaacgttacgggaaatcactccggcagatttaccgactgaagttttgtcaactaagcgtatgttagatcagctgataaagtggcattggattaaacaagacaatcctcatgatttacctgatttgctttgcggatggcgtagggagtttggattattgttattaaaggctttgcattaattagatgctttgttaaatttttgggaacgaactcaagaaatcaaagggtatacaaattgataccctctatatttttagacagggaagaatgttgatatcttccctatatgtcaatctttaatcaagatatttgattactttaattactttatttacccctgaaacatgacgagcgacttctgcagctgcatctgcttgagattgagttaaatttcccattaagaatacttcaccattttcagtaatcactttaatatccgctgatttaatatttgaattgacgaataacttagatttaatttgtgtagtgatccagccatctttactaatttgtccaatagtaattggttgtgcaaggcgtaactcattatatacttcgtcaacaagttccactcctctagctaaattagttgcctgtacttttaaactattattcggaacttgtccgattaataaaattcgggagctataagaaactacattaacacgcccttcagcttttatttgtgcatcttttttaatcgctgacaagactttttcttccagtgtttcatcatcaatttgagtacctactgttctcggatccgttgcaacttttaccgcaactgccgtaccggtagcaataccaatcacagtggctgttgcacaaccttgtaataaaagagctgaactcagcaatagccctaacgttttatttattttcatctgatttctccttgttgaaattttgcctagtttgggttgaaacatggctttttgtcaagaactatgaatgtgaaaataatgaataatcaataagctcacataatgtgttaataattagcagatgattttcaagaatacgactttccttaccggtcggtactgaaatttctaaatcatttgccgttaaaaatccttgtatatgaccgttattttcaccggttaaagcgataatttgtacatctttatttaatgcacattgcaatatatttagcatcgtttcttcattgccgaaaggagaaaaaataattaatagatcaccttgttgtgcaattgcgttaaattgtctttgatacaacatagtatgacaattttcggaaataatggcagaaccgaccgcactatccaaacttaatagaacggaaggaaagctagggcgttccaattcatatctattgagtaaatttgctactaaaaattgtgcattagcataggatctaccatgcccacagacaataattttattacctttcagcaggcaatttacaatatgttgagttgcctctacgatttttgttgcaagtaagctggaggaagaaatttgagtttgaatactttccgtataaatatctttaactttttctaacataatttttattcatcaagaaaattaggtatccattggatatcatttgttgttgctccaaaagcgaccagatcgaaacggcagtccgcatcttctaaactggaatcatattgtgctaaccataggttggctgcatcaagccatttttgctgctttttccaatctacactgtcaattgctgaaccgaaaatttgatttttacgctgacgaacctcaacaaaaacgatcgtttgccgatcttgcataatcaaatccaattcaccgcagttaaagcgttggttagctgcaataaaggttaaaccttgtctctctaaaaagaggcgagcctgatattcaaaactcgcaccttgttgacgtttggattgtatcattcttcgttaatcagatagatgctgtcatcttgctcgttaagcggatagatactgccattttgatattggaaccaagtcatatcacgttcaacattacagttagggccggcactgagttttcctgttaacccatcaatggtaaatccgggaatttgacggaattcattaaattgatttattaataaccaagcatcataacccatagcatataaatgcattaatgagtaatcattattggtcattttttcaatttttttatattgttccgattccctatctttgaagaacggaatatcactaaattgcagattattcagaaacaaacgatgttcaggaccactgttaggcgaattactacgtgaacttgcataaagttttagggtcggattaatattatccaacactgctttaatttcagctaattgtttgttattagcaataatatacacgccgtcagtactttcacttaaccccgattttaatgcaaaattaatatctgcggtttgattatagaatttaatattggcatcagtacccaatagttgttgccaacgtagagtaaatgccgctgccgtgcgtcgccccagattattttgcggtactaaaacaagtggaatacgtactgcatcattccacattttacttgccgcactttcagcttcatcttcaggcgataatccataataacaaaggtgttcaattgcccgtgcattaggcgtagagttcaacgctaatacatttaaatcttgtaccaaatacggattattgactataacatcaacattttgtttgagtaatggtccgacaagagtgttaattccctgtttttttgcttgattaataatttgttctatagacattttcattgagtcaaatacgtgaacttgaacattgtaattgactttggcatcatcaaacccgtttttgattgtttcaccgataagtcgtgtattgccgcttaaagggagtattagaccgacttgcgttaaagtagtttgttgaaaattggcaagcccttgtaattctgtaggtaataaatgtgctgccgtatgtgttggataataatttttccaagtcagtaatgtttgaattaattgtgcaggttgattaaggttatcattgtatagttgagctaatgttaaccaaccgctcaatgtaatatttccttccgcatcagtattatttagtacttcactatctgtattgcgtagcaatgcccaagtgcggtcattattttgttgttttcgttgaatatcacttaaaaaattatccatttgaattcgagcttttatcgctgaaatattatcatgacgattttctgcaatacgagaaacaatctcataataacgtgatttttgtgaaggactaagtaatgtcaagtgaattaaagataattgatattctgccgtttcatttttgcctttaacagcagaaatatgagcttcaatcagggatttatctagtttttgttcatcatttaaatctatcaattcagcaagatatgcttccgcttgcgggattttattttctgttactaaaactcgagcagctaaaagtttataggtttgtaaatcttgttgattttgtgtttgttcaattttccgaatgtaaaaatcagaacttgcattggcatcattttttaagcttgccgtaaagctactgcctaataaattgacacagcctgctaaaaaaaacataactaaaatcgggagaaagcatttttttaagcgtaaaccttgcattaaaatagataacataaattgctccttgagtatgtgcaatgtaaaatgcacggtgatcttacttatctcaccaattaaaagcaaataaaagaagtgaaaaatgaataattcgacaggaactctatacgttgttgcaacgccaatcggtaatttacaagatattactcaacgtgctttagatgtatttaccaaagttgatttgatcgctgcggaagatacacgtcatagcggtttattactgaatcactacggcattaaaagaaatttttttgcgttacatgatcataatgaacaacaaaaagcagatgtactgattgagaaattacaacaagggttaaatatagcacttatttctgatgctggtacacctttaatcagtgatccggggtttcacgtggtgcgtaaatgtcaccaagcaaatatccgagtggtcccattacctggagcttgtgcggcaataaccgcattatgtgcatcaggcatcgcttccgatcgtttctgcttcgagggatttttacctgccaagagtaaggcaagacgagataaattggcaaacttagcaaatgaagaccgcactttgattttttatgagtcaacgcatcgtattttggattgcttgactgatattgaacttgaattgggagccgatcgctatgtagtgcttgcacgtgaaatcaccaagacttgggaaacaattcgaggagatcaagttggaaagttgcatcaatggctacaagaagatcttaatcgaacgaaaggagaaatggtgctaattgttgagggcaaatcaaaaagagaagatgaaacattttcccctcaagcgattaaaacattacaattggttagccaagaattacctttaaagaaagcagcatctattgttgctgaaatttatggctataagaaaaatgcactttaccaatttggtcttattcaaggttactaatataatgaggctataatctcaggtttaatttgggtataatcgccaaactttttaggtctgatttttaaggacaaatatgagtcaatttttttatgttcattcagaaaatccacaatccagactgattaatcaggcagtggagattttacgtcaaggcggcgtaattgtttatccgaccgattccggttatgcactaggttgtatgattggagataagcatgcaatggatcgtattgtgaaaattcgccaactacccgaagggcataattttaccttagtttgtagcgacctgtctgagttatcaacttattcaatagtgaataattcggtatatcgtttgattaaaaataatacaccgggtcgttatacttttattctaagtgcaacaaaagaattaccccgtcgtttaatgacatcaaaacgtaaaaccatcggtattcgtgttccggataatcaaattgcgttagatctattaaaatccttaggcgaaccaattttatcctgctctttaatgttgcccggagaagaatatacaacacaatctgatccggaggaaattcgagatcgccttgagcaccaagtagatttaatcattcatggcggatatttaagtcagcaaccgacaacagtagtggatctgacagaagataacccggttattttacgagaaggaagcggtgatattcgcccttttatataaattaactttattcattcccattatcatagacgcttgtgaaagcgacagtaaggaaaataaatgaaagtaaataagcaaaaatcccgtccaactaaaccgcactttgcaaagcaggttaccaacgagtctatgcgagataatacgaagcgatttgcaaacaaagaaacagtatctgaacgtaaaagtgcggtaaaaaacactcaaatttctccaatatcaacaaaatcaactcatgctatcaatcagcaaaaagtcgaaggggaaagactacagaaagtgttggctagagcaggacaagggtcacgtcggacaattgaagcaatgattagtgccaatcgtattagtattgacggaaaaatggcgactttaggtgatcgtgttgatatacattccggcgtaaaaatcagaattgatggacatattgtcaatttaacgcaagcacaaaaagaagtatgtcgagttttactctattacaaaccggaaggagaactttgcactcgacatgatccagaaggaagagcaacggtttttgatcgtttaccccgtttaaacggatctcgttggattgcggttggtcgtttggatattaatacatccggactacttttatttacgactgatggtgagttagctaatcgtttaatgcatccacgacacgaagttgaacgcgagtatgccgtgcgtgtttttggggaagtagatgatgcaatgattgctcgtttacgtaaaggcgttcaattagaagatgggcctgctaactttaccagtattaaagcaacaggcgggcaaggaatgaaccaatggttcgatgtcaccttgatagaggggcgaaaccgagaagttcgtcgattgtgggaatcacaaggcattcaagtaagtcgtttaattcgtattcgctacggtaatattaaattaacgaaatcgttaccacgtggcggttgggaagaaatggatctaaccaatattaattatttacggaaacttgttgggctaccgcctgaaacagatagcaaaattgatactaaaaaacctcgtcgtataaaaacgggacaaattcgtaaagctgttaaacgctatactgaattgaataaacgttataagaaataaaaaacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtttttgatggacagattgagcttgatgaaagctattttggtggtcatcgtaaaggaaaacgagggcgtggagcaaccggtaaagtggctgtttttggcttgttaaaacgacagggaaaggtatttacggtggtggtagaaaataccaaaacagaaacgataatgcctgtaatcacaaggaaaatcaagcctgacagttgggtttataccgatacatatcgtagctatgatgctcttgatgtgagccaatttcaccacgaacgcatcaatcattcggagttgtttgcagtgaaagaaaatcacatcaacggtatagaaaacttttggagtcaagccaaacggatactccgaaaatataatggaattaaccaaaaaaactttcctttgttcttgaaggaatgtgaatttcggtttaactttggaacaccaaaagagcagttaaaaacattgcgaaaatggtgtggaatttagggctgatctaatacagccccaaaacttatttaaaagtgtgaattaactcacaaattttaaattacgtatttgcattatagaacatgattttttacattgcaccttataaaaagtgctataaaaaagtagccaacatattttgctttccgagtagtgcctcttttgaggcactttttttgtgtttgcataaaacaaaaaacctagcaattcaaaggttatcgctaggttagataaataaattagttaaacacgccgctgatgccgacacggaaacctactcggcctcgactatcagaagaaacaccgccggatatggcatattttccgtttgcggaagttctaccgaggtttaaagagaccgcactttcgctgctataatgagcggcaccggcggcataagaccattttcccgggacgaaagggacttctttgaaagccatcgcggcggcgataccggcttttgcgtctttgttgacttcttcaagacgttggttagtggcgtgtaattggcttccgttgacggcatcggttgattgatgagaaagcaaaccggcggcaacattttgaatacggcgttcattgcctttgctgcccacggaaacgacgccttttgcatcaacgccggcgtaattgccgttgactttaccgataccgcccgttgtttcgcctttttctacataagcagaagaatcaccgaggaagacggagttatcaacctcaacattaatattattaccgataacggtagttttagttcctttgtttacaatactactaccaattgagaatgagcgttctttatgtgtttgtacatcgttaccaatacttaaagagcgatctccatacacttttgcttgaggaccgatggcttgtgatctaagtccagcagcatgtgaatcccaacctattgctgtagataattcattgrtgctwytrgattkataaccaaawgcattactataaktgccagaagcygtagcaccttgtccaagagccgaagcaaatttcgcagttgctttygcytcatcacctactgctactgcaaaytttycagttsctttagaatctttacctatagaaaycgcctgtacacctgcatttgcttggwagcccattgctacggcataagmttgtgcctctgctgtcttaccaaccgcagttgctccttcatgtgctgcatttgcttcaaatcctacagcgacaccggactcagctactttggcattttttccaacggcaacggatttggtaccatccttatacattccttctgccttagcaccttcaccaatataaatatgcccattactaatcttaatattattactatttgattgttgagcttgagccatagccgaatgagcagttaaaacaactacygcagttaaagataaataaaaaattttcacttaaaagaaatccttaaaaaaagagttaacatagaaaaatcataaaaaagctaaccgcactaagaggcgataatttatgacacgccttaaaaagaggtagtggttctaccaaagcgggcgaaattgtaagcgggggggggtactgtcaataaaaaaatgaaaaaatgtgaaaaaagataaaaaaagtaaaaaatgaagataagaagcaaaaaagtgagaagtacaagtaaaaaaagtaaaaaaagcccgcactttttaacaaaaagtgcgggttggattgggaaattttgggttatgtagaaagcgagaagctatgatgatagttttggcttgtggcttataagtaacgtttaatccgttaagattttttttaccttttctttcatttggttgaactccaatgatattcattggagagtagttctgaaagttcattgaaagtgttttgcgtaaaaaagaggaatgctagtctcttaatttagcgggaggaattagtagaataatatccgcccatcgcactgtaaatcgcattttgactttgaattaaactgtatttcgcattcagaatggctaattgagaggcattttccatattagctgcattaagccattctattaattctgcgataccggcatcatagcggtttttgtaatattgcgtaatacgtttgttgtaacggtaagtctcttgtaaatttgcaacattttcttttgcttgggtataagagaaatagaggttgtctatttcatttagagctttggtgatgttttgttcaaaattcagttttgcattttcataagctgcctcagaaattttaacattccattttactgtattccaatttaagaaaggtaagtttatgcctaccgttcctgtcgcaatcggtatgttgaaagcattgtcaattttattaccgcttgatgataatcctgctcccagtgtgattgatggaaaccaacttttttgcattgctttcgcatttttaaatgcactattgaggcgatataaagagcctttaatatccggacgattggcaatggttgataatggaatatccaaatttacctccgcacttttgacttccaagatatttggtgttttgatgtttaaatcttcattcggttttaagttaagcaaattacgcaggatagtttcggcacgttttttttgtgtttgataattaatcagattattacgagccttaagaattgattgttgtgattgatctgtagttgcccgatctgctacaccttgcttgaatttattttgcataattcgactaatttttgagtaataattaatcgtttggtttgttactgcaatggcatcatttaaataggcaagttgatagtaagttgtgacaactgagttgatcagagagagttttgttgcttgtaaatcttgttgcgtagcggaatgtgtccattttgcagcagaggttttatcggctaaacgttgccataaatctagggtgtagctaatattgagtgaaccgccgtgagtaattttagagttgctccctgtgttaatatttttggcagctgaagaattaacgcctgtttggcgtgtgaaatttggtactaaatccgccgcaaccaaattggcattgtacagagccgtgtttactgcaatagtggctttggcaagatctttattattttccaaagcttgtttcaccagttggttaagcggctcgtcattatattgtgtccaccaattttcctgaatgttatattgttgagtcaatgcttcatattgctgaaaatcttgtaatgttgcatggtaactatcatcaatatttgcacaaccgattaatatattagacaccactattccaaacgtcattttagaaagttttaacataagttttccttatcttgtaagcagaaaagtgcggtctttttttccgcattttctgcaaattttatcatgtttttattcatgtgtcagagaggaaattgagtttaatttagatgcctttttgaaggtatatttactttaaaaaatggcttggtagttcctgatcacatacgattatgtcaaatttatctatcttatcaatataagctttttgaacttgatttatttttgatgaatcaattaccaaaatagcttgctcggttttctccattgctttttgttttgtttttacttcatcaaaattaaagcaagttacgcctttatttacatcaatccctgcagctgagatgaacgcttttgttgtgcaaattgcatccagttcattagttagctgaataggaattaaaaaagagttattctttgaataatttccaccgcacaaaatgacttcacaatgaggtttatcctgtagcaccataaaggtattaattgaacagcaaagtgcggtgaatttaatggcaggatcgatttgtgaggcgacgaaaggaattgttgaaccacagtcaaaaaaacacacatcgccgtctttaatgaaattagccgcaatgcgacccacttccattttttcggcaatatgctttgtttcttgctcaaaaatttggtagctgttatcggtgtttttttgtggatttttgacaatatagccaccaagtaaaacaactgagcctgtatctgaagccaaatcacggcgaattgtcatttccgatacatttaaaatagtggcagcatcacgcaagtgaattttatccatttgtttgagcaaaaagtctaatttttgaatgcgtgattgtattttcttatccataacaggctctattaattaaaacggttaataaatagcgttattgtctgttaaaccgttaataatagcaatccctgaacttgatccaattcttgtcgcaccatttttaatcatttcaattgcggttttagtatcacgcacaccacctgaagctttgacaccgatattttctccaaccacttgacgcattagtgcgatattttcaaccgttgcaccgcctttattgaaaccggttgatgttttaacaaatccgacccccagttcacgacaaattttacaagcagtgataatttcctctttggttaacaagcaagtttccaaaataactttaagtaaagcaccttcacaagcagctaaaaccgcttgaatgtctgcttttacggattcccactgatttgatttaatccaaccaatgttaatcaccatgtctatttccgttgcaccggcttttattgcttctttagcttcaaaagcttttacagtagataaattagcacctaatggaaatccaactactgtgcatattttaacatttgtattttgtaatttttgtcttgctagcggaatataacctgaattaatacaaacagaaaaaaaattatgttcaatcgcttcgttacaaagatccagtatatcctgttctgttttctccgcagttaatgctgtatggtcaatgaattgagcaatgtcataagattgcataaatatcctccttattttaggtttatgtgattattttcacttttttatatgatactgcaaaaaaaattaaaaactgtgactttaatcacttttttaacatttttaattttatatactgaataaaataaattttgtgagaattataacatttattacggagaaaaacattatggatattgcagtcattggctcaaatatggtggatttaattagctatattaatgatatgccgaaaatgggtgaaacgctagaagctcatgattttaaaatgggttgtggcggaaagggagcaaatcaagctattgcagccgctaaattaggtgcatcagtaatgatgatgactaaggttggtgatgatgtatttgcagataatactattaataatttcaagcaatatggtgtgaataccgattttgtcgaaaaagtggtgggtgtatcgagtggtgtagcccctatttttgttgatcgttcttcacaaaatcgcattttaattattaaaggtgcgaattcttacttgaaaccggcagatattgatcatgctgaagttcagttgaaaaactgcaagctgcttattttacaactggaaattcctttagaaacagtttattacgcaattgattttgccaataaacatcaaattccagtcattcttaatcctgctcctgcaagtaaggaattagacattagttatgcttgtaaatgtgatttctttatgccgaatgaaactgaattggaaattctaaccggtatgccagttgataatatggaacagattcaagcagcagctaatagcttatttttgaaaggattaaaaaatctgattgtgactttaggcgaaaaaggatcggtttggtttcatcgggatcaggtaacacatgtctcctcgcacaaagttaatgctattgatactagtggtgctggagatgctttcattggttgttttgcacatttttatatacaaactaatgatgtcaaacaagcaatgcaaatggcatcagcctattcagcctatagtgtaaccggacaaggtacgcaatcttcttatccggataaagcacaattcgaacaatttctacaatcgttaaaataaggagtatggtatgaaaaatattcaacaaatgcccgatggttatctcaataaaacacctattttccaatttattttgctttcttgtttattcccactttggggagcagcagccagcttaaatgatattttaatcactcagtttaaaagtgtatttacgctgagtgattttgccagtgctttagtacaaagtgcattttatggaggatattttttaattgcgatacctgcatcattggtgatcaaaaaaaccagctataaaattgctattttaattggcttaatgctatatatcggtggttgttcgctattctatccagcctcgcatatggcaacatacacaatgtttttagtggctattttctctattgcgattgggttaagtttcttggaaacctctgcgaatacttatagttcaatgattggacataaagatcatgcaacgttgagattaaatataagccagactttctatccagttggtgctatttcaggtattttattaggtaaatacctcatcttccaagaaggtgccagtcttgaagaacgaatggtaggaatgacaccggaacagttgcattcatttaaattatcaatgttagaacatacgttgtcaccatataaatacttaatcttcatattgattgcggtgacttttttattcgtaattacctcttttcctaaatgtaaagcagttacacaaacaggtaaatcagaagtgaaatttaccgatacgctaaaatatctagcaagtaatacaaaatttaaaaagggaattgttgctcaatttctctacgttggtatgcaagttgccgtatggtcatttactattcgtttggcactcaatttaagtgatatgaatgaacgtgaagcctcaaattttatgatttatagctttattggattctttattggcaaatttgtcgctaatttcttaatgactaaatttaagtcagatctcgttttactttggtattccattttaggtgtgatcactctagcttatacctcttttgttcatgatttttctgctgtttatgcggctattttcgccagtttgttgtttggtccttgctgggcaacaatctatgcctccgtactggatactgttaatcaagagcatagagaagtgggtggggctgttgtcgtcatgtctattatcggtgcagctgttgttcccgcaattcacggttatgtctcagatacattaggatctcttcaacttgcatttattgtacctttattctgttttgcttatgttggctattatttttatggaaaattaaaagaaaacaaggagaaatagtatgaaaagctacctttatttatctaaatcacaatttacagacaaagaacaacttatttttaaaaatgaaaagctaagtgcggtcgcatttcaatatcaatccggtattgaggcggtcaaactgatcaatagtaaaggttttctaattgttttacctttttatgggcaaatcatttgggacgttcaatttaacggacaaactctcacaatgaaaaatatgttcaacgaacctaagcggggaacaactattattgatacctacgggtgttttgctttccattcaggcttaattcgtaatggttgcccaagtccaaaagacgagcatcctttgcatggtgaaatgccttgtgccgtaatggataaggcttggttgattattgaagatgacaaattagggattggtggtgaagttgaatatgtgaaaggtttcggtgagcattattcagctagaccggaggtgatattatctgctgacagtacattatttaatatcaatatggcagtgacaaaccttgccagtgttgatatgccgttacagtatatgtgtcatatgaattattgctatgaacatggtgcaacattcagccaaaatatccctgaaagtgcggtgcaattacgccaaactattccggctcatgtgaaaccgacaccgcaatggctatcgtttaatgaggagattaagaaagggaattatacactgtcatcgttggaaaatgatgaaatgtataatccggagatagtgttttttatggataatttgcaacaatatcagtcacaacttgaatatcgtatgcgctccccgaaaggtcataattatttggtaaaattctcgtcagcacaattcaattatgcaacacgctggattttatataatgccgatcagcaagtgggtgcttttgtcttaccagcaacctgtcgtccggaaggatttttggcagctcaaaataatggctcattaattatgctaaaaccaaaagaaatgcggtattttagtgtcataacaggtattgaataacatatagcgaacaacataaatgcggttgacaaaagtttaacggtattgctaaatgcatatttagttaaaatatcctaatgaaatgtttaaaaaaattggcttttataaaaatctcttgtataatcgccggaccctgtgaatgtgtcggatttcccaccgcacattattttatcaagatcacactcgaaggggtggagattaagattgatggttgtgcttaagtttaataagcactgggtattaatattattctattggtaattaattaatgaaaacttttgtagcaaaaccggaaacggttaaacgtgactggtatgtagtggatgcgacaggtaaaactttaggtcgcttagcgactgagttagctcgtcgccttcgtggtaaacataaagctgagtatactccgcatgttgatacgggtgattatatcgttgttatcaatgcagaaaaagttgcagtaacaggtaataaagaaactgataaactttactactggcatactggctatgtaggtggtattaaacaagcgactttcaaagaaatgattgcacgccgtccggaagcagtgattgaaattgcagttaagggtatgttgccaaagggtccgttaggtcgagcaatgttccgtaaattaaaagtgtatgcaggttcagaacataaccatgcagcacaacaaccacaagttctagatatttaatcacgaggttaggaaaatggcagagaatcaaaactacggcacaggtcgccgcaaaagctcttcagctcgtgtatttatcaaaccgggcagtggtaaaattgttatcaaccaacgtgagttggacgtatatttcggtcgtgaaacatctcgtatgatcgtacgccaaccgttagaattggttgaattaactgataaattagatttatatgtcacagttaaaggtggtggtatttccggtcaagcgggtgcaatccgccatggtataactcgtgcattaattgagtatgatgaaacactacgtcctgcattacgtgcggctggttttgttactcgtgatgctcgccgtgttgaacgtaagaaaatcggcttacacaaagcacgtcgccgtccacaatactcaaaacgttaattttatatacaaaattgcaagccaaatggcttgcaattttttttcttattttgtcggtaaattatgatggaggcttatgcattgccttttcatttatggtagaatggaaagtctttattaattttcaagtcgtcggaggaaaagatgacaagcgctgcgaataaacgttcaataatgactctttttttagataaggttgatatttattgccatcaggttcgtattgttttagctgaaaaaggtgttgcttatgcaacagaaatagttgattctgaatctatatcagaagatttaatggaattaaatccctatggcacaattcctactttggttgatcgtgatttagttttattcaactctcgtatcattatggaatatttagatgagcgttttccgcaccctccattgatgccggtttatccggtttctcgtggtaaaagccgtttattaatgttacgtattgaacaagattggtatcctgtattagaaaaagcagaaaaaggttcagagagtgaaagagctattgcattgaaacaattaaaagaagaaatcttggcaatagcacctgtatttagccagtcactttattttatgagcgaagaattcagtttagttgattgctatattgcgccgttattatggagaatgcagcaacttggtgttgtatttacaggcacaggcagtaaagcgattaaatcttatatggagcgagtttttcaacgtgattcatttttacaatctgttggtgaaatgacacctaaaaatttaatggaggataaataggattaatatgtcgtataaatttttacctaaacgtccctatttattaagagcctattatgattggttgattgataacgacttaactccttatcttgttgtaaatgcaacttattcaggcgtaaaggttcctgttgagtatgtcaaagatggtcaaattgttttgaatttatctgcaaatgcgacaggtaatttattgctgaataatgaggcaattcagtttagtgctcgttttcagggggtatctagagatatttatattcctatgggagcggcattagctatttatgcacgagaaaatggcgatggagtcatgtttgaaccggaagcattttatgatgaattaaatattgacagtgttgatgaacagcctttaggttttgctgaagcagttgatcaaaagaaagtgaaaaagactgaaacaaaaacccagaaaggaacatcacatttgcgtattgtgaaataaactaaagcaattttttgaaccgcacttaaagtgcggtttttttatgaaaagtaatttaatcaattcttgtagttagaaatttgcattacgaggtgtgcgagggaatggaattacgtcacgaatattttgcacgcctgtaacataaacaattaaacgctcaaaacctaatccaaaacctgcatgtggaactgttccataacggcgtaaatcacgataccaccaataatcttcagcttttagtcccatttctgctatgcgtttgtcaagcacttctaaacgttcttcgcgttgagaaccgccgataatttcaccaattccgggagccagaacatccattgcagcgactgttttaccatcatcattcaaacgcatatagaaagcttttatatctttaggatagtttttaactacaaccggcgatttgaagtattcttcggctaaataacgctcatgctcagaagataaatcaatcccccaggatacaggaaattcaaacgctttaccggattttaatagaatatcaatcgcatcagtatagtctatttgagcaaagtctgaattgatgaaatcttttaagcgagtaatcacatttttatcaacatgcttttcaaagaattttaagtcatcttcacgttcatttaatactgcacggaaaacatatttcagcatatcttctgctaattttgcattgtcagctaaagttgcaaaagcaatctcaggttcaaccatccaaaattcagctaaatgacgcgttgtatttgaattttctgcacggaatgtcggaccaaaagtatagattttgcttaatgcacaagcataactttcaccatttaattgacccgataccgttagaaaagactctttaccaaaaaaatcttggctaaaatcaaccgcacctttatctgtgcgaggcagattttctaggtccaaagttgatacacggaacatctcaccggcaccttcagtatcagaagctgtgatcaagggggtcgctacccagtagaaaccttgttcatggaaaaaacgatgaatagcttgagctaagcaatgacgaacacgagctactgcaccaatgatattagtgcgtggacgcaagtgtgccacttcacgtaaatattcgatactatggcgttttgcagacattggataagtttcaggatcatcaacccaaccggaaacttcaattttgttggcttgtaattcaacagcttgtccttcagcaggagactcggcaatttttccagtaacaacaacggaacaaccggtagttaaacgtaaaatttccgtttcatagttttcaatatcattatttacaatagcttggataggatcaaagcaagaaccatcgtaaatagctaagaaagatagtcctgctttagaatcccggcgagtgcgaatccaaccacgtactgttacagtttcaccgaccgtgatttttccttttagaatattagccacagatgcaatttttgtcatataaacctcaaatcagtttttataattgtaaaacttagtcattttaccgtaactcattaaaattaccaaaatgtatcggaactttttgtttttgtgagatagcacacataatttatataagtcccttgtttattaggaaaatttcttggtataaatgaacaattttatgaattaaaataatcaggtagaacaggtagaaaatatggcaaaagtgagaaaagaggataaattacctctgagaatgaagcagctaggcaaaatttatcgcttaattgaacaatttgaagaaatttcacgtattgatttatccaagttatctcaactggctcctgcaactatcacctccttaactagagaacttatagaaaaaaaattggtgattgaaagagcggtacaaaatacggaaaatcgtggtcgtccggcagttggattatgtgtctcaccattttactggcaatctctttgtgcaacactgacatacgatcattttgatattttgctatgtgagctggatggcacaacaatagcccaagaagtttatcctcttgatctttctgatttatcttcattagaacaaatgttgccttgctattttgaagattttttatcaaaagttgggactaaattgagtcgtccgattactttttctattgcagtggcgggtaaactacaccatttgtctggttttctgcaacgtttgggggagatcgaattaaatgtggatctaacatctttatttgcaggctattttgatataccgattattgtaacggaatattttgaaacttggttattagcggaaagcacattaggaagcgtaataggatatgatgatgtgattttcttgcaaattgatgaagtcattaatttgagtgttttatcaaaaggggttattctacagagtgatcataaaacttgtatgaatattgaccaaatcattgttcctcgcctgtatccaatgcaagataagatcaatcaacatttatttgagcttgagcgatatcaaatacataatcaattgacttataaagcattttgtcaatttatagatctgtattatccaaataataatttaattaacacgacagaaaagatcaattttttatgtaaaaaagcacagcttcaagatcctttagcattagaaattttagctaacatagccgatattattgcatacatcttatccaatttagttaatcttttttcacctgagaaaattatgtttacctctcgtttgctatccgtcaaacatgttttccttaatcaaataaatcagcgtttagcacattatttgcataattcaaaaatatgtgaagtaatgacgagccagtatgaatggaatagtcatgaagttattgctgctgctattaaacaaaagatttatgatggtagtttgttagtttatatggaaaaatattaaaatttttttcacttagctgtcaaaaaggcgttagaaagcatttttgattgcttgactataaataaaggtttcagctgaaagtatcatagcaagacttttaacttttaagagttaaaggcttttggggtagcgaatttacgcccccagctcttttgaaatggattgtgctgtttgtttgagatgcatgagcaatatatctttgccgatttggtttaaacgtgcagttgatagagaaattgatacggagtagattacattgctattgatgtcaaatattgggcaagctaaacaagttacgcctgtttcattttcttcattatctacggcataccctaattctcgaatcttatttaactccagctccatagcactcagtgttacaattgtattagctgttaattttgtaatattcgtttgatttttctcccaataatcatctagaatgtgtcttttttcgtatgccataaaaatttttcccatagctgaacaataaagttctaaacgctgaccaatatacgctcgtgtacgcatcatacctgttgttggttcaagtttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagatgctcaagaacatcctgttggtatagtttggtctgctaaattatatgaggtgcaaaaatacttaagcttaactaaccatggttatacgccattgattgttgttatgaacaaagccaagttcgatgctctgtctccggcattgcaaacagcattagtcgaagctgcacaagaagcaggtgcttatcaacgccagcttaaccttagaaatgaaaaaagcattattgaaaaaatgcaaaaagcgggcgttgaaattattgagcgtgttgataccggaccgtttagggctgccattgaaaacgaagtacgcaaggcattcattgagaaaaatggtgatgatttagttaaaaaaattgatgcattagcaaaataagtatattcaatgataagaaacagaatttttattaaattgaccgcacttttacttattccttattcggaaggaggagcttatgttggcaaatggagacgttccaatccttcagctacagcatatcgtcaaacgattcggtaatcaggtagcggtaaatgatgttagccttaatattcaccggggagaaattgttgcattgctcggtgagaatggtgcgggcaaatccactttaattaaaattctggcaggtctctattctcgtgatgaaggtgaaatttattttcatcaacaaaaaatccaatcggtacaatctcttaccaataaaaataaacaacctattgcttttattcatcaagatttagggctggttgaatggatgacgattgctgaaaatatggcatttgtaatgggatttcctcgccgtttcggcttgattgattggaaaaaaattaatcaacaagcacaagaagcattggattttgttggtattcacctttctgctcaaactcgagtttttgacttaagtcgtacagaaaaagcgttattgaccattgctcgtgcgattgctgtcaatgctgagattttagtgttggatgaaccaactgcctctctacctgcaagtgatgttgaacatttattcaaggtgcttaatcgcctacgtaaacagggcgttggtatgatttatgtcactcaccgattggatgaggtcattaggctttctgatcgcattttagtcatgcgtgatggttattctgtggcagaaggttcgactaaagattatgatgtgaaagctctagtgaaggctattgttggtgaagaaacaagagaaaaacaacgtgaaccattgcctaaaaacacaccagaagtggtacggcttaacgaagttgttgttggtgataccggtcctgtttcctttagtttacatcagggcgaaatgattgcattagcaggattgcgaggtgcgggacaagaagagataggacgattattatttggactacgtaagttggaaagtggagacattagtttaaatgaatgtgcttatcatgccgagtcgccatgtgaggcaatttataaaggtgtagcacttgttgccggagaccgtatccgagaaggtcttgtcatgtcaatgacaaccatggaaaatctctttatcaatcctatcttaagcggtcattttccattaaaaaattatgcaagcaaaaaagaaaggtctgaatgttggtatcaattccagctctttgatattcggccgaaaaatttatttattgaggtcagttcgctttcaggaggtaatcaacagaaaattgtgcttgcacgttggatgcagctcaatacacctgtgctgattttagaagatccaactgcgggtgtagacgttggtgcacgagcagaaatttatgacttattaaatcaagccttgaaaaaaggtgttgcaattattgtgatttcaaacgattttgaagaaattgcacatctttgtaatcgagccttggtattcaaccgaggcgatatcgtgggtgaattattcaacgaacaagtcacatttgcgaatttgctggcactcgcttcggacgcatctgctaccataaattaattttcgtgtttttagaccgcacttaaacaataggagagcatcatggctcaaacaaatattaaatcaaccgctttagaacagcctgtatctattgcacgtgatgggttttgggcgtgggtttctcaaatgatcactcgatatgggttactctgcttatgttttttacttatcatacttttctctatgacaacagattcttttgcctctatgctaaccttacatgcgattttagaaagtaaatcaaaaattgcactattggcactcgcagcgacgacgaccatgattgtaggcaaaattgacttaaatgtaggttttggtattgttctttggcatattttagttattacactacaagtgcaattcggtttttcatggcaaatggcgactatcacagtactcattgtggcagcaatttatggcttacttaatgggattttagttgcacttgctgacattgatagcttcgttgctacattgggaacgggaacggtattgtatgcaattgctttatggcattcaggcggtcgccaaattgtcggtgatttacctgatgcttttattgctattaacagtactgagatcttaggtattcctatctcggctttttatgtgttaatcgttgctattgtcatgtggctggtgactgaacacaccccaacaggacgttgtatgtatgctgtaggaggaaatcctaccgccgcttatttgaatggtatttcgattaagaaatatacgattgtgccatttattgtatctagtttaatcacagggtttaccggagttctcatcgcagcacaacagggtgttgggcaagcaagtgttgggatggattatcttttacccgcactagtaggtgctttcttaggtagtaccacaattaaaccaggacggattaatgtttggggaaccgttgttggaattgctattctcgctattggtatttccggtattcaacaattcggcggtgctttttgggtcgagccattatttaatggtgcaactttattattatctatcactatcgcaggttatgcacaacgtaaacgtttattaggtcaaaaagcagtacacaagaaagcagcaacaaaataatttgttgtgttaattacccactaaaaggagaaaatttatgaaacagttttttcattgtagtttaagtgtagtggcttctgtagtcgcactctcttttgccggcaacactatggcaaatgatccatttgtcgctgaagcaaaacaacaagttgctacagctgctgctcaaaaaacaacttgggatggaccaacaacaggtccaaaagtacaacaaggaaaaaatattattttcattgcttctgatatgaaaaatggcggtgtattaggtgtaattgatggtatgaaagaggcaacgagtatagctggctggaaattagatattcttgatggagcaggtgcggtcaataatcaactttctgctttaaaccaagcgattgcccgtaaacctgatgccattgtcattgggggttggaatccaaatgtagcaaaaattccacttagcaaggcaactaaaaatggaatcacattggttgcatggcatgctacaccggaaccgggaccaattaataaatataatattttctataatgtcacctctgattctgaccaaattgctaaactctcagctcaacttgctgtagcaaactcagatggaaaagcaaaagtggttattcttaccgattcactatatgaaattgcgttacgtaaagcgaatgtgatgaaagaaattattgagcaatgtaaagaatgtcaggtactagagtttattgatacgccgcttgcagatacctcaagtcgtatgccgagcctaacttttagtttattacaaaaatatggtgataacttacaatacacacttgctattaacgatctctattttgatttcatgacaccgtccttacgttctgcaaacaaaggagaaatgccatacaacatttctgcaggagatggttcagttactgcctatcaacgtattcggactaataatcatcagtttgctaccgtaccagaacccctgaatttacatggttggcaattagtggatgaacttaatcgtgcttttgctggagaaaaaccctctggttatgtcactcctgctcacctagtgattaaagacaacgtggcatttgatggtgggaataagaacctttatgatccacaaaatggttataaagaagcctataaggcgatttggaacgtgaagtaatcaactattgtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcttcgatgcaacaagagttgctggataagcattacttacgtaaacatggtaagaatgcttattacggacagtaaatatgacataagtgctaaagtaaattgctttagcactgagttttagatgttattaagaatagcgtctaagacagaagcaattcccgctttatcatggtgtagagtgatcaggtttgcttgttgtttaatttcgtcctctgcattacccattgcgacacccagtccaactaatttaagcatagaaatatcattatggttatccccaaaagccacaacaaattgagggtcaatgtgccatgtgtttagtaactccaataatcttgagccttttgtatttccgctattggcaatatcaacacgatcaacccatgaccactcacaactaaacccaattgaagataaatgattaaccgcagtttgcatcaacgcacgatcaggatggctaattacaaatttccatatcgtttcctgatcatttaataacacattaaaatcaggaacatggcgtagtttgggatgtacttggggaggacaacgctgtacccattcggaaaatttacgcagatgctcattcattattgagtaattcattgtatcacgtgaatacattaataaatgtaaattgtatttttctgccagttgaatgacttgtcgggattgttctaaagagagaggatttgctgcaagtacggtatctgtttgtggttgatacatataggtaccgttacaacaaatcatgggagtagttaaattcagctcatggtaataaggataggcggcagtatgatgccttcccgtgactaaaatgacttttaagcctttatcaatacaacgttgaatcatgattttatttgacgttaaaatttgcccttggctatttaacaacgtgccatcaagatcaaacgcaatgacttggtatttcatcttttttcctattttgaatatcatctaattggtaaagtatagagctttttaagtccaaagggaatatattagtctttgcagggataggacaactgtataattctgtataggaaaattaaataaaactgaccgcacttttatgctcaccttataccgttacgatgcaattattttcaataagtacaatgatgaaatgtgttatgattaacacatttccagttttgatgtagagtaaattatgagtcaacatgaatctcacttcaatcattttgccttagccgaactgtatccttttgctacacaatttcctttgcaaaatataataggaaaaaaaggcatgcgaatcgtctatcgccattttgttcaagaacattgtgctgaacgtagattagtgattttggtcaatggacgtgcagaaaacttgttgaaatggacagagttggcttataacttttatcgacaaggctatgatgttttagtgtttgatcatcgtggacaaggctattctcagcgtttattaaaagagcatgacaaaggctatattgatgagtttcgtttttatgcggatgatcttactttgttagtggaaaaaattacttcgttgtatcactatcgtagccaacatattttggcacattctttaggcgctttaatcagcacttattatcttgccaatgataatcaccaaataaaaagtgcggtattttctgcaccattttatggtattccactgcagcattcattacgagatgaattcattattaatttaatgatgttgcttgggcagggctcacgctatgtatttggcaaaggtgagtataaacccgctgatttagataagaatgatttgagtctttgtcgtactagaatgaaatggatgaatcgtattaatcgtcgatacccacatattcatttaggcggaccaacttttcgttgggcatatgagtgtatgtatgccattaaaaaattacccgttgtcttaccccgaattgaaattccggtactagttttacaatcagaaagagaaaaaattgtggataaccaaaatctgcaaaaattgaccgcacttttgcctcaagctcaactagtgcagattgaacatagtaggcatgagattttatttgaacgtgatcgaattcgagacttagcactagcaaaaatcaatcagttttttactgaaaataacgccaaataaacacgcctaatgttgtaaaaaacaagcaaccgagaatatgtaacgatgtaatagttatgccttctagccatttatgttgaagcagattttcaataacttctgcactgaatgccgaaaatgttgttaaactacctaaaaatccagttacaaaaaataggcgatattcagttgaaaaagcagacgaatgccaaaacatagccagcattattcccataattaaacaaccgatataatttgcgattaatgtgccaaaggacaagaaagtaaacaacggattgagtaataatgtcaatccatgacgagacattgcaccaagagaagcaccacagctaattaagaataaatgtgtaaatagattcatatgtgtataataaacagaattaaatgatgttaaatagcgtgcagagatacctcgctaccgattcttgtgcgtttaacccaatgatttctaaattcgggcaagttgactttaaacgtggatcagcattactcatcacacaacctttaccaactttggttaacatttgtatatcattcataccatctccaaaagcaatacattgctgcattccataattccgctcggctaatacctgctctagtgcagtggcttttgatacattttgattcattatttctaaacaaacgggagttgaataagtaatgctgagtttgtctccatatgtggttttgagagatgtttcgatattgactaagtcttgcggttcccggccaaggaaaaacactttttctgtagtttttccatgatgttgagcaaaattcactactttatacataaaaccggaatcttgatggtatttacgcaactgaggaacttctgtattaataaaccaatcatccccttgatatgaattaacacatacatgtgtacgatcaaaaggtaagttcataatttcaaatgctattgtttcaggaatgtaattgcggactaaaagattgccttgcaaatcctgtgctcttgcaccgttagaagtaatcattactgcatttttgatcttaattttttttaagattggtagcaaatccgtatggttacgccctgttgctaagataatatctataccttgagatgcaagcttttgtagtgtctcgatagtgaaatcgccaatcatatgattggcattaagtaatgtaccgtctaaatcagagacgatggcacgaaaaggaacattttgcatagcctatctttatcctatactgaaatcacagaacagattatttaacccaagtgacgatttcatcaagggatttacgggattttggcttaatttcttttgctcggtagccgaaagttgccattaccgaaactccccattcgtctgaatctaatacacctgcgtcagttaaaatttgatttactttttcataattaaaaccttcaattggacaactgtctattccaattaatgcagcaccagttaacatatttgctaaggcaatataggtttgtttacttgcccagtcaaataaagtgcggtcattctcaagcgttttcatatgttctgcttgaaagagatgatatttttctttggtagcttgtatttgttcgccggataacccacgtcttttcatggattgtactaaaaattctgaatcatagcgtgcattctttttcgctaagataacaactaaatgactggcatcgtcaatttgagttgccattccccagctgacaggttttaattttgcccgtagttccggattttggattactaaaaaatgccaaggttcagagccgacagaacttggcgaaaggcgagcaaattccaaaacataagagaaatcttcatcgctgatttttttatttggatcatagtaacgtgtggatgcacgacgattaaaactatccagcacgtgttcttttgaaatagtcgtcataataaatgtcctttaaatatttagcgaattgccatttggaataaaaccacttcagcttgacaaccaaaaacaatacgcatttttaaacgaaaaccatttgaaatgtcggtaatttgactctcaatatttgcagggtcattttcaatatcacgagctttctgaataaaataatcacgagcgttcaacgcttgtttttccgtatcgtattccgcttcaaaaacaacttctcttgcggaattatccagcattgaatcgcctttgatacggcacatattgtgtgcttctgccactttttgttgcaatgttttatcactcatgattatttccttatgcttaataaattaacctaccacactcggtaataaacctgcttgaactaggaatggaataatcacaataaatacaccaataactaatacagcgataagggaggctgagccaccttttactcgatacggtaagtgtgggtaaattttacgtaatttccataccattgcaataggtaaaacgattgcatagaatgcaaacatttgtcctgcatatcctaaagctaggataaacccttgaggatagaatagtgcaaaagcaagtggcggtaagaaagtgagcagaccaactgaaacacgattagctgaaatatttactcgttttagcagatcttcaatcgcttcgaacaaacctaaggcaacacctaagaatgaagtaattaatgcaaatgcagagaatagacgaactgcaccgccaataatttcacttcctgtaattgtaattgttgctgtcaccaatccatttaaggttggatcttgttgtaagattgccaaaaattctgtttggcttagtacgccatgagtggctaattgccatagaatataagcaacaagtggaataaaggttccgactaagatagaaacgcgtaatgcctttacatcgccatcaaggtatttattcaggctaggaatagaaccgtgaaagccgaaagaggtaaagaaaatagggcttgctgagatgattaaggcattatcaattggaagtgcgagtaagttttctaaagagactttaggcagtaataagaaaagcactacaacaaagaaagcaattttactgaaaaaaatgatgcgattaatcttatctacgctatttgtgcctgaaataatgaaaataccgaaaagtacagtaaataatacacctgcaatccgagatgtggtttgttcatcgtgaatggtgggcaacagtcctgcaagtaaagagcttccgccggaaatgtaagctgaaactaaagcgtaaagaaaaattaacagtacaacagtagaaagaatacgtccgaaagatccgtaatatttttcagccaaagtcccaattccagcatcactgtctacagtctgatatagctcaacgaaaagtagggcggcaaaagagagtaatagccaaagcccgattaataaagtaagtgtaaagccaaaaccgattccggctgaggttaatggcatagcgagcatgccaccgccaattgttgttcccgctacaataagcgtacttccaagcgttttgttcatatttttctcccatgatgaaaataaaagtgcggttattgtaacttatatttttttaaaagtgtaattttatttttacaaaatgtaatattatatttacacatttgttttaggaaagagaattggcttaggatcttgatagaacaattgtactttttgtccaatttctaaggattgcattgtttgaatggtgatttgttgtacatcagatagagtaacttggtactgataatattgccctaaaaattgactttgagttattgtaccatgcccctgtaaagttggtatgacctgaatttgatgtgggcgaaccagccaatgtaactccgtattttgtaatagtggagattgatcagcaagtgtgagtaagttgtcgataggctgtataccaaagattgaatgtaattgattttgttgatcaatatagcaatcaatatagttatatttccctaaaaattcagccacaaatttactgttaggttggtaatagagttgatctgttgctccgacttgaataatttttccatctttcatcaatgcaatattatcggcaaaagcaaatgcttcttctttgctgtgagttacaaagattgctgaaatgctttgttgtttcactatttgtttaatttcatcaatcatttgatagcgaacttggctatcaatatttgaaaaaggctcatcaagcaatagtagttttggcttgcatgctaaggctcgagcaatagcgacacgctgttgttgacctcctgacagttggtgagggtaacgatcttccagtccatctagatgaactaagttaagcatattttgcgaaatttgctttttttccatcgcactttttttatccaaaccaaactgaatattttctttgactgttaaatgaggaaaaagagcataatcctgaaaaataaaacctatgttgcgttgttctacagggacaggtgttaaatcttgtccatttaagtagatttttccttgtgtaataggctgtaatccggcgatggcttttaatagtgtcgtttttccgcaaccacttgctcccaataagcataaaatttcattttttttcaattctagatcgagttgatgtaagacaatttgttgtttgtattgacaactaagtgattgaattttaagactattcattatcgatccttttctgaatgtaaaatgagtgaacgagtgagccaaataacagggattaaaccaacgagaattaatgttaatgcaggcaaagcggcatgttctaattgttcatcggaagtaaaagaaaaaacataagttgctagggtatcaaaattaaaaggtcgcaataacaatgaggcgttaagttctttcatactttcaataaacaccattaaaagtgcggttaaaattcctttagaaagtaatgggaagtgtactttttttaacatttttatgccattagtacctaagctttgacttgccatatctaatgtaggaggaattttttgtaatgatgtttcaatacttccgagagccatagcggaaaagcgaatgacataagcggaaactaaagcaaacattgatcctgaaaaaattaatcctacaggagataaatttaactgagccagtatagcgttaatttgatgatccgcaaatgtgtaaggaattaaaataccgatagctaaaactgtaccgggaatagcgtagcttaaactcgcaaagcgtaaggtgaattgtgcactacgttgtatgtgatttgaatgtagatttaagcgttggtaaaaatgtaaaagcagagcgaaaattacacaaacaattgaggcggtaatagaaactgacaaactgttataagcatattgtgaaaatttatagagttgtgattgttcaaaataatgaattgcccaataactcaattgtgcaacaggaataaagaaagcacaagtgactaatccccagcaataagtttgtactaaaaagccttttattccttttaatggcttaagtgcggtctttttttcataccctcgttgataggttttttgtttgtaacggctataattttccagcaataagagactaaaaataagcaataaaatgaacattgagatttgagcagccgagccgagatctcccagtcctaaccaagtgtcataaactgcggttgttaatgttggcactgcaaaataagatacagtgccgaaatcgcccaaggtttccatcgcaactaaagcacaaccaatagcaattgcagggcgagttaaagggaaaataattttttgtaataacttgcgtggtgagcttccaagtaatttagcactttgaattaaattttcgctttgttccaataaggctaaacgtactaataggaaaatataagggaaaagaactaaagcaagaacaatgcaagctccccataatgttctaatggaaataaaccaataatcttgtgcacttgaccatgaaaaagtttgccgtaaaaatacttgtacagcaccggcatagtctaataaatccgtataaagataagcaactaaatagccgggcatagcgagaggtaaacacaatagccattgtaagattttttgtccggtaaattgatattgagaaataaaccaagcacaaggcaaagcgaaaactaaactaaaagaaacagttccaataacgagaagcaaagagtttagcagataatcaaacagaacagtttgccaaagatgttgaatgttttgccaattgaggctccaagattgataaaaaatagcaatgatcggtgttacaaaaaacaacgtaataaaaagtgcggttaaaaaccaaataattttatttaatcttgaggaaaataaaaacattcgaaaactaattataaagtaatgtaaagtttaatggggcaattatagcataaactcaaagtcagtgagatcattaaatgcccagtttagaaacaggataaacaaagaaaaaagcctagtggatttagcatactaggcttgttcttttagcaaatattaaagatcgaatttgacttcatcaataagttttaatgctttatcgtagttttccgctattttatttagtggtagcggatctttcttaaatgttccccaagattttactttttcagacggttcaacaccagcttttactggatattcatgattaagctctgcgtataaatgctgtgctttatcaccacttaaatattcagcaagtttaattgcattttctttatttggtgcatattttgcaatagcgataccgctaatattaacgtgagtaccttttgctttttggttagggaagttgatataaacagcctccgcccaagagcgttgtttttcatcgtctagcatttttccgaagtagtaactattgcctaaagaatagtcacatacaccttctttaatagctttcacttgatcacgatcgccaccttgtggtttttgtgccaagttgttttttagtccttctaaaaatgcttttgcttttgcttcaccatcatgtgcaatcatagaagcaacaagagaaacgttgtaagtgtgtttaccagaacgcacacaaacttttccttttaattcaggttttgctaagtcataataagtgaaatcagcaggtaatttacctacacgatctttagaagtgtaaatcgcacgagcacgagttgttagtccaaaccattgatcattagcatctctatattgtgctggaatatttttttctaaaatttcgctatggataggttgtgcaagacccgcattcacaatttccatcacacgtttaatatcaacagttaataatacgtctgctggacttaattcaccttcacgttttacacgttcaactaagcctttattatcaaaaagaacattaactttaatccctgtttctttttcaaactcttttaaaatcggttcaataagataaggttgacgataggaataaacattaacttcatttgcagctaaagcactggtggaaacggtcgctgctaaggctaaggttaatgtgctgagtgattttttcatgaaaactccttgtaagaataaatattaagtaaaggatacgaaagagctgtattaaatactttaatagattaaaagtcaataagaattattcttgattgtgtaagtaaaattttaagttttatgaccgcactttacacaaaagggaaaataacttgattattttcccttttaattcaatttggtaaagcggttattgccaatattttttctttgaggtttgacctattcccggattgaaactatttgttgggtcaagggctttgtagaatttgcgtaattccggttttgcttgatacaaatgcccaacattatgttccgccggatattccgcaccacgctgatctaataaatcaagcatttggtgttccaattctatacaattatgaccttttttaatgatatagtcttggtgaaaaacatggcacataaaatgaccgtaataaagtttgtgtataattttattttcaatttcagcaggtaatttttcaaaccattctttgtcattacgacgcaaagcaacatccaaagcaacgatatcttcaacatctttatcgtgaattgcacgataacgaattgcagccgaagcaacagcaaaacggtgtaacattgctgcttgagtttcttctgcattacattggaaataattacctttagagttatcggaaaaatactcttttaagtattcttgagcttcttgaacacctgtaccacctatttttacaataagatgatgttcatattggtcacggtattgccataaggatttcggtaaatgttccggcatcgcttttgataaaatttgcataaacttatcactgaaatcattgggtaaaaaactgacttttttggcgattcggtcaactttagctttcaaggcaaataatttaggtaagcggtgtgtgccaaattttttaataatccaaaaagtatctttaccgtatttggcggcaatgtcaaaagcatcacgatgaatatattcgccagagattggcaattgttggaaattagctaacatatgacgacgaatgtcgtttaacacatctgtttgatttgttccaatgtagaaaactgcggtatgtttttccatcggaaacgtatctaagcggactgcaaaaacagctaattttccggcactcccggaggtttcataatgtcggcttggatcagcgttaaatcttgctggagagttttcatcaatttggcgtacatgttcgcaataagaatgatcgtgtcctctgccacaatgttgttgaatatctttgcgttgataacgttggttttgtaaattttccaaaatttcttcaggatcattacctaagtcaatgcctaaatgatttttgagttccaattctccctgttcattaagttgagcataaagtgccatttctgtgtaagccggtcctctttgcaccaatgcaccgcctgaattattacatataccgccaataacagaagcaccaatacaggatgaaccgataacggaatgaggctcacgcccatgtgtttttaataaaatttccaattcatttaatgtcgaaccaggtaagcaaacggcttgttcggcattattgattagctgaataccgttcatatacattgtattgataatcacaatatcacgatcatagtcattaccgcttggtgttgatcctccggttaaaccggtatttgcggcttgatttataataattacatcagcctcaacacaggcttttaatacgttccaatattcaaccagattagtaggacgaacaacagcaatcgcatttccgttgccaaaacgatagccgctacgataactttcagttttgcttggatccgtaataataaatttattgcctacaatgtcggtgagcttggagataagttgttgagttgtcatcgtcataaaatgttccttgcttatttgaaaaaatcgacaacattataacaaatgaatgttgactagaaatgatgaaattctattcaattatacagtttttttgatgattaaaaagataattgagtttgagctaacaataaaagatgagttttgttgagaaatatgatacaaaagactccgaatttttatttactcttaattaggaaacgatatgtcgaatttacaaaatattattgagcgtgcatttgaacgtgtagcagaaattaccccgacaaatgctgaagcagaacttagagcagcggtagatgaagcgattgaaggattagataaaggtatttatcgtgttgcggagaaaaatgaacaaggcgaatggattgttaatcaatggttgaaaaaagcggttcttctttcttttcgtttaaatgacaatgttgtagttgatggtgcagaaacaaaatattatgacaaagtgccggtgaaatttgcagattatgatgtagaacgttttaaaactgaaggatttagagccgtaccgggagcggttgttcgtaaaggttctcatatttctaaaggtgttgttttaatgccgtcttttgtcaatattggtgcttatgtcggtgaagggacaatggtcgatacttgggcaacagtgggttcttgtgcacaaatcggtaaaaatgtgcatttatccggaggcgtagggattggcggagtattggagccattacaagcaaatccaacgattatcggcgataattgctttattggtgcacgttctgaaattgtggaaggtgtgattgttgaagaggggtgcgtaatttccatgggggtattcatcggtcaatcaaccaaaatttacgatcgtgaaaccggcgagattttctatggtcgtgttccggcgggttcagtcgttgtatcaggtagcttaccttccaagtgcggtaaatataatctttattgtgcagtaattgtaaaaaaagttgatgcgaagacgttaggcaaagtaggcattaacgaattattaagaactatcgaatagctaaaattcatgtggtttctattatctacctgcctcttaacataagaggcagattttttataaaacaatagttttattttgatacacaaaaattctgtcatgaagtgccaaatctaaagcctgcgttagtaccgctttttctacatcacgtcctgctttcatcattgcttccgcattataagtatgatcaacattaatgacattttgcataataattggtccctgatctaactcattattaataaaatgtgctgtcgcaccaataattttaacccccctttcataagcttgatgataaggttttgcaccgataaatgcgggtaaaaatgaatggtgaatattaatcactctattgggataacggctgacgaattcgggatttaaaacacgcatatatttagccaaaacaatataatctggagcatattcgtcaattttttcagctagtaatttatcatgttctactcgagttaatccttcatggcttacacaatgaaacggaatatcaaaacgctcgaccaacgaacacaaagtttcatgattcccaatcacagcggcaatttctacatctaatccgccataataggttttcattaaaatgtcgcctacgcaatgtgcctctttggtaactaaaattacaatacgttttctttttgcatcaactaaacggcaatttgtaccattcggtaaactatagtctaaatcggcaagtaaagtttgttgattaaaaataccttccaattcagtacgcataaaaaagtgtttagtttcaaaatcaacaaattcattattatgaataatattgagctggtgtttgtaacaaatattagtaattttagcgattaaacctttatcatcaggacaatctgttaataggattttattttcaaccataataaatagtgatttattgtgttaagttaaaaaaaacttaagttagagatttatagcatgattaaatttcgaaatcagccaatgtttttcctgtatttaattcagcttgcagagataaaggcatacgcccctgacccgtccaagtttttactttaccattttgatctgtatattggtattttgctttgcgaggagctatttttttacgagggcgtttagtggtaaaggttggatcatcgactaaatcagtcaaggttaagccgtcttgtgctagcaatgctttatattttgcgatacgttccaaacgttcttgttcttttcgttgattttcttcaattagttgacgtcgttcatttgtaattaattgaaatttctccaatatactttctaactcttgcagagtgaattcttttgttgctacacgcaatgctcgaatactggttaatgtttttaataggtcagacatttttactccttaattttatattgataattcgctttcaaataataacgaaaaaatatttttaggtaaatcttaatttaaaaatagtctaaattttaattttatatattagtttaattattttacattaattatagattaatacttggaattttgattttcttattgtaatcttactcgctcctacatatgtagaggtgcggctgttataagtaattttttgagtggataacgatgaaaaaaatgaaaggaatagttgccgaaatcaattaaaagtcattttaattggttgggggcgtattcgaaagaaacgtcactgtcatagtatttatccactatggagcgctactggttaggttggtatgggttattttgatcaccttattttaattatatttaaaatatcaatctcagtggttctcccttaaattaggaagaacaacatggaacttgtaaattattccacatctatttattcggttattccaccgatattagctttgctattagccattgtaactcggaaagtcattttatctttaagcattggtattattaccggtgctttaatgttgaccaaagatacatccatattggatagtattccttatttgtggaatcatatctccgctttggtttatagtattgaagaaaacagctcaatcgcatttgcgtgggacacaataaatattatcctctttttagttttacttggtgttttgactgcacttttaactgtatccggtagtaaccaagcctttgctgaatgggctcagaaacgtattaaaggtcgtcgtggtgcaaaattaatggcggctgctttagtgttcgttacgtttattgatgattatttccatagtttagcggttggtgcaattgcccgtccggttacggataaattcaatgtatctcgagcaaaattagcttatattcttgattcaacagcagcacctatgtgcgttatgatgcctgtatccagttggggggcttatatcattaccttgatttcgggactattagcaacttatgccattaccgattactctccaatcggtgcatttatggcgatgagttcaatgaatttttatgcaattttctctattttattggtatttttcgtggcttatttttcatttgatattgggtcaatggcgagacatgaaagattggcattagagagaggggatacagaaagagaagttgaaatacaaacaaagataaaagggcatgtacgaaatcttgttttgccaatagtggtattgattgtagcaactgtggcaatgatgatgtataccggcggacaagcattaattgctgacggtaaagcctttagcgtgctgggtgcatttgaaaacacaacggtagggatttctctcgttgttggagggattgcctcagtggtgatggttactctctgtattttaactgatggtcagattagtttaaatgaatatataaaatcttggggattgggtgcaaaatcgatgtccggtgctattttaattctgtgctttgcatggacgattaattcggttgtgaaagatatgcaaacagggacatatttatccagccttgtatctggcaatcttcctattgcaacgttaccggcattacttttcatcctcggtgcagtgatggcattttccacaggaaccagctggggaacatttggaataatgctaccaattgccgcagaaattgcatcaaatgctgcccctgaattaatgttaccttgcttatctgcggtaatggctggtgcagtttgtggagatcattgttcccctgtatctgatacaacaattttgtcctctaccggagcgaaatgtaaccacatggatcacgtaacaacacaattaccttatgcgttaacattagctatggcaacaattgtaggctacttagttgtcggtttcacgttatccggattgttaggttttatcgcttgtggcgtaacattagctgttttaatgttaattttaagaaaacgctaatatcgttttaattttgtttttgaaccgcactcataagtgcggtttttattagagcggagtttaaaataagtgtagaatagacaaaagttatcgtttatttcttatttaggagtaggagcaaaacatggcaatcttagttaccggcggtgccggctatatcggttcgcatacggttgttgaattattgaatcatcgttttgaaattgttgttttagataatttatcaaattcctcggaagtttctttacagcgagtacaacaaattaccggaaaaaatatcactttttatcaaggcgacattttagatcgagaaatactacagcgtattttttcaacacataaaattgaagcggtgatccattttgccggattaaaagccgtgggagaaagcgtaaaaaaaccgttgcactattatcagaataatgtgaacggttcgattacgttactggaagaaatgctaaaagcaggcatatataacttagtttttagttcatcagcaactgtttatggagaccctgaaatcattccaattaccgaaacttgtaaagttggcggaacgactaatccctatggaacatctaaatttatggtagaacgtattttacaagacgcagtgagtgcaaatccgcacttgagtgttgtcatacttcgctattttaatcctgtcggtgcacatgaaagtggtttaattggagaagatcctaatggtattccgaataatttattgccttatatcagtcaagtagcagtaggaaaattaccacagctttcagttttcggtagtgattatgatacacacgatggtacaggtgtgcgtgattatattcatgtggtcgatcttgcaattgggcatctaaaagcactggagaaacaccaaaatgatcaaggctgtcatatttataatctaggcacgggaattggatattccgttttggatatggtaaaagccttcgaaaaagcaaatgatattcaaattccttataagctagttgaacgccgtccaggggatatagcaacgtgttattccaatcctcaaaaagcattagaaaaattaggttggaaaactgagcgagatttaacacaaatgatgaaagacacgtggaattggcaaaaaaataatcctaatggttataaatcgtaagtcgtaagtgagcgttttaacatacggataagacaattcagctatcaacatttcaataacaacagaacaacgttgagtgtttctgttgttattttaaacgatttagcaaaaaagataggcgacaaatcgcaaagaataaacttttttctaaaaaacattttctttacatttaaagttaggataaaatcgcccggataaattaataatacttgacaaataaaaatagaatagaaaaatgtctacagtctacagtctacagtctacagtctacagtctacagtctacagtctacagtctacagtctacagtctagtatattgcctaaaatcaaccttgcaaggtaaatttgtgaggttggacatgttcaaacaacatcttaaaaatcacctatttcaacctcaacctttcggcgaaartattattcgyctttttctrctttgccttaaaaagcaaagcgtcgcctatttattcatcaaactatctaaaaagcaaaaagtttaatcaatcaacaaccataaaaaagttaaaaaaaatcaaagaaataaacaattgaacaaccaattttaaaagattaaagagagtgaaactatgaacaaaatcttcaaaactaaatacgatgtaactaccggtcaaactaaagtggtgtctgaattggcgagtaatcgtcaattggcgagccgtgttgaggcgacggagaaaacgccgaagtgcggtgggtttttgagaatgtttaaggtgttgccattggcgttggtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctataggaactagtgcaacagctaacgctcaaaatagtgtagcgttcggaaatgaagctagcgtaagcatggaaaattcggtggcattagggaataaatcacatacaaaatatttctatcaaaatgataataacaaaaacactgccacgctcatcggaaacggcaaaaatgaggcgattgagttagccccttatgttccagagggttctagctataacttaacaaccgataaaacagcgggtattgtgtccgtcggttggannnnnnnnnnnnnnnnnnnnnnnnnagaactgggcttaagacggattgtcggggtagcaccgggtgcgttggattctgacgtggcgacgattggacaattaagagccttagcctatgtaaaaaaagagggcgtggtaacttactataccaaagagggaaacaagatcattaagctgaccaaaggtgatgatggtaagttctataaagtcaacaccaaagacggcacgccttacaaggacttaggtgcggttgacgcaaaaaatgttttcgttggtccaaaaggggcgaatgaaaccaccaaagaagaaatgattcaatggaaaaaatactcgctcggaaatatgggcgaaagaatcaaatttgctaatattttagatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacctttttatttaggttcaaccattgtaatcaaagcaggggatgttacaaagtcaggtacaacgacagagaactatctaggcaaaaacctaaaaacagaatttaaaaacgatagttcaaaagcgacattcaccatcggcttgaaagaagccccgagctttaaaaaagtcacgattgaagacaagattgaggataaagaagctaataaaaaacttgccgtcaacaaagagtatgtggataacaaactymaaaacgtttcgacgaatttacatttcttatcagtacaagggaatgataaagccgcagtcaactataataacgatggagcaaaagcaaattattctgttgctattggggtgaatgctcaagtagtagatcctactactagtggagtgcctcctaaaaaaacaaaaccgacagcaacagcaggtatagcgataggatataacgctaaatctgaagcagaaaatgcggttgctataggtagagatgtaagtattgacgtaccgaattcttttgttatggggtctaataatacagttacgcaaagctttaaagagacaaatggtgcggttgttgtgatcggtagtggaacaaaattagtagaatcaaaaagttctattgctataggtgcggtttatgtggaaagaggtgacaaaaaagatggtactgtaatagagaatgcagcttggacagcgtctatcgggaataaaaataaaattaaaaatggtacggatattgttgcactggggaataatattgaagtcaaagatgaaacaaatgaggaaaatccaaaaaataaaacaagaattgctaataatgatttaattctgattggtaatggagcgacagctgaaactgcaaaagaaagtgtgcttattggggcaaaatcaaaagctgaaacgggtgcaaaaagtgcggtgattatyggtcatagtgctaaagcmgargcaarygccgtcggtgcagtagcgattggrcaaggtgcaacagtaaaaaccgmcgccggcaactccattgcsttrgggcaagggtcagaagcgacggcaaaagaagaggctaaaaaagatgctactgtaagttttgacagtacaaatattaaatttaaatggacaggaggcgttagttccaatagtggtgataaaaaatccgttttaagcataggtaaggcaggtaatgagcgtatcattaaacacgtcgccgcaggtgcggtaacggaaacttcaaccgacgctatcaacggaagccaactttacgcygtcgcygatgaattttcwaaattagcggtgaatgtattrggtgcggaaaaagccgacggcgatacagcaggatttaaaaaatcgaattttgaagtagctaaatatcakggaagtacaamtgcwycaacacmaamrgaaatgacytttaaagacgcaattggtcaaaatacaayagcgattaatmaaggctttatttttggcgttggcgatcawastrrtgaataaggaacgcattacttaggcgataaattaatcatcaaagcgggagcaatcgataaaccgacgacaatcacgacatcagaagatggctattcgccgaataatattaaaacgcactatgaaaaaaatagtaaaaatatattaatcggcataaaagataaaccgacgtttaaaaatgtgattattgaaaatggtattcctgaagatgaggaagagcttaagaaaggtaattatgataagcatgctgtcaacaaaaaatatttagacaaaagattagaaaaagtcgccgctaatttcacggttaagggggataattctaaagatggaaaaagttataccttagataaagagcataatgaattaaatattaatggagatagtgaaaatatcacaaccgcagttgataaggaccataaaaaagtcagtatcaacttaaaagatactttaanaggtatcacttcaattgctaataatgatacaaaaattgaattaaacaatggaactggtggaagtggaacaaaatctatcgttttcacagttggaaattcaagtaagaaagtaacattaactgaagataaattcagtggtgtgtctgaaattggaaaagatgatcaggctaaaattactttcaacagcaacggtcaaaaagaaatagactttaaagcagggagtacaacctataaatttactgacagcggattagatttagctagcaaatcaatcacaaatctagcaagtggattagataatgttgtaaataatggtaaaaaagacttagacgagctattaaaacttgttgatacaaatggacaaagtggtggatcatcaaataatggcaaattaaataaagcaatcaatgcaggcgatttgcttcatgtcgctaatgaattaaaaaataaagggctgactttccaaggaaatggtgatgatactgacaaagttaccggaaaactgggcgaaaccttaaaaatagttggagaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatctatcgtcttcaaaactggaactagtggtaatgatgtaacactaaccggagataaattcagtggcgtttcagaaattagcagtaaagacagtaaatctanattaanacttgrtgctgataaagcaactgtagaattagmwcatgrcaaatcaaaacttgaattaaaagatactgaagcaacaatcacagctggagrtaatgccggaagtattaaaattacaagtaatggwrryaagaaaattgagttaagycctgaaaayggagctaaattaacacttgcaaaagatagcactactaatagtggctctagcaatgttaaagctaccggtttatctcwtgttgggttaaatgaacaaaacgctttaatytttaaaaatggaagtagtaatagcaataccgctgttttaaaagtgggtaatgctgatttaacatttacacaaacaggaagtaatggaaatcaaaaagtccagatttcaggattatcaagcggattaactgatattggttcttctaccggtactagyggcaataatagtactcaaaaattagatgaattattaaaactaaaaccacaaycaagtggaacatcaaataatcaagacaaattaagcagagcagtaaatgtagaagatttacttgatattgctcaaggcttggtkgataaaggacttaaattccaaggaaatgacacttcaagcacaataacaacaaarctgggcggtactttaaaaatagttggagaaacagcaactkcaacatcrggaacaactgcaacaactcaaatkacmaccgcacctgataacattackgttaagaaaaaatcaggtagtgamgatactttagaaatagggttatctgatgctttaaaaggtattacttctattagtggtaaaaatggcagcaatggaagtgcggtwgcgaaaattgaatttacgaatggcggyacwggtggcagtgcttcaaccagcccaacggtmaaaatcacmrcwggcrstrgmacatttasctttggtgaaaatggcttggatttaggtagcaaaaaactcaccgcacttgctagcggtttgggattaacaaacggtgtcggtactggtggaagtactgtaaacggaaacgaggaaattattgaaaatattctcaaaggaacccctgatggtagcaatggttcccctaaaattgccaacaacgcygtsaaygtsaaagacctrtcccaagtcgccmaagcgattgtkmmwaaaggmytgacytttgcmggraatacaggtgaggttaaagcckcactyggcgataaaatcacgattaagggtgatgrarcktatttraccagcaaggcttcttcaaatggtggtaaagaaattgwgttttcwttracrgatagyacgaaaaayaaagtmgatatwatcaatgtcggyactamcaacaacggcgayaattcytttgcsttgggtaaaaattcaaaactagagacgaaaaagaccgcacctagtggaattataccgaatgcaggaaaagatgaagtcaaatttagctggacaacagcaggggcttctaaaactacaaatcctgttgatatgaaagaagtcattagtgttggtaatacaaacgctgaacgcattattacscaygttgccgcaggtaawgtcgataccggytcaacygatgcgattaacggyggacaactaaaaagygtcattgatgtctttgctaatttagggataagtgtattgggtgckgagaaagccgaagctgacaaagacggytttaagaaaactmcatttacmgcattraaaratacwagcggasmaaaygrarcrrctaaagayacatttaaagacgcaatcaatgcyaataytgmcaaaatcaacgagggcttgaaatttaaaggagatactaacaatggwagcaayrgygagcaacaactctacctcggytcraccttgacgattaagggagcggraacyaccgcacaaacatctactcaaggtgcgggtgcagccaaacatcaaaacattacyacwacsgcmaaarayggtggaatactkgaaatcgctttgaacacgaatttraargacattacmtctatygggaaagatgawaataatgttttaacgtttraaaatrgyacaagtggtggaaactcagtggaattaaaagtcggtggagccwctttaacattcactmmawcwggaaatggtgacaargttaaaatytcrggtattgcagatggtgaaagtgagaacgatgcggtaactgtcaaacaattaaccgcctcaaaattgcattatttatcggtaaaaggaccaaatggaactcaaaacggtgagaattacaacaatgacggtgcaaaagcccaaaattctattgctataggttctaaggcaagtgtaaaagacgacaaatcacacgatgccatcgctattggttataactcattggtagaaaatgccaaatggtcaatggcaattggtgccaatactcaagctaaatcaattcaatctttggcgttggggtatgagacaaaagtattagaaaatagcgatgcttcaatcgccatcggtgtatctgacacaaaaatagaaaatgctaaatgggcagtagcattaggaaacaaaataacaataaatggttccggtaataatgtagttgcaataggaagtaatattaatgtaggaagtggcaacgatgatttaatcgtaataggaaatagaggcgacagttcaccacaaataacaaacgccaaaaactccgtcattatcggcaaacaggcaatttccaaagccgaaagtgcggtggtactcggtaaaagtgcgactgttcaagcaagtgccacaggtgcggtggcgattggtgaaggtgcaacggtagctgaaaccgccggagattctgtagcgattggtaaaaactcaagagcagatgaaaaaatgtttgcaccggacggaatagacgctaatgttggtagtcagtcgttgaaaatcaattggaaagacgcaggtgcttcagctacagataaagattataaatccgtgttcagcataggagatgttgacaatgaaagagtaataacaaatgtagctgcaggatatgtaatagatgggtcaacagatgcagtaaacggcggacagttatatagtgtaatacacacatttggcaatttggcaagtgatgtacttggtgcagaagttaatactgatacggataaggaggcagatggaacacctaagtatggcttcaaaaaatcaacgtttgttgctgttcaatataaggatagaacaaaacaagcgaaagacacattcaaaggtgcaattgatgaaaccattaccgccatcaacaaaggccttaaatttgccggtaatactggtgaaaagcaacttcaactgggcgacaccttagcgattaaaggtaaagaagatagtgcaaacagctcccataaaaacatcagcacagaagcgaaagacggtgatattttagaaatcgccttgaattcagagttaaaaggtattaaatccattgaaaacggtgataatgcaaaaattgctttggataaagacgcaaaaaccattaaatttacctcaggggatacaccgacagaggttagtttaaaagctagtaccttgagcggtatcactgagattaataaggcaacggacaagggggcgttaaaactcactgagaacagtgcgaccttagaaagcacgaaagacaattcaaaacttgaattgaaagacaaaacggcgactttagaaagtgccaaagacggttcaaaagttgagttagcagatgacagtgcaaccttaagtgcgggtaaagrtrmcggaagtattaaagtyrkcaatggcacggagaasaaaatcgagttaagycckgaaarcggctcaactgttacgttgaaaaaagacacgacaaatggtaatactgtcaaagccascggcttatctaccatcggtaaagatgatagtaacrccttagtgtttaaaaacggtacgagtggcacaagtggcacgaacaccgcggaattaaaagtgggtggtgcgacgttgacctttacaccaacgaatggagccggaaatgctaaaaccgtgaaaatctcaaatgtggcggttggtaagatagaaagtagttcatcagaagctattacaggcggacaacttgccgatttagctactcatttaggggttgatgttgatagctcaggtaaaactgcgtttacagcaccatcatttnnnnnnnnnnnnnnnnnnnnnnnnnnnnnaacctttaaaggagcgattgatcagttaatcaccgcagttaatggtggattgacattcaaggggaatgatacttccccaacttcaaccacattacaattaggtggaacattgaccattgatagttcgacggttggtagnnnnnnnnnnnnnnnnnntgaaaaagacatcaccgtatcattagcaccaaatgggcaagatgttaaaaacgcaggtacacttacgctgactttaaataaagcaaccacggtttctgaaactgatgaaaaagtcgttacttctaargctgtwgcaacararttgaarractatacsamracggcwgakttagacraarrmtatctcaaagtcgatgggtctaatattgatgaagatgacgaaaccaaaaaacaaggcagaaaaacattcggtggcaatgtcggtatnnnnnnnnnnnnnnnnnnnnnnnnnnnnnnnnnnactgaattagtacaggcggatgcggttattaagtatctaaaaggtacaggtcaaaaatccgttaaagtatccgataatccrgaaactraggctgaaggrgwckrttctattgcgattggcgataaagcrrtrgcaaaaaatgaargkgcaattgctatcggytatggtgctaatgctaaaaatagaaacgcactttctataggcagagatagtgaggtattgggcgagcatgctacggctattggtttccaaaataatgtattgggtaacgattccggtgcattcggtaaagataataagattagcggaacgcatgcttacgccgtgggtgcttataatgacatcaaaggcgaacayacttatgtcttgggttcaartrtyacgacaactaaagatataacaaatgctgttatyttaggtaatagatcaacaggtgtatctgatgccgtrtctgtgggtagtgctggcgatggcgaacaaagacgaattgtttatgtcgccgatccaaaaaatcaatacgatgcggtgaataaacaatatgttgatggacttggattaaaattcaaaggtaatgataatcaagagatacataaaaaattatcagacacattagaaatagttggtaagggtttaaataaagctcaaactactaaatttaatggcacaaatggaaatattgctgttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagaagcggactattagaaaaacacaacggaaatgattctgaaagaaaaggtttagacgatttaataggagaaaattttgataaatcatcgattaaaactcatgcagtcaatgttggagatttagctaaaatttctaaggaaatagttgaaaaagggtataaatataacgctgatattctgtcaggtaatagcaatgataccagcataaaactaggctcaactatatctattgttaaatggacagacacaccggcatcagggactggacaaccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccagcagtggcaagcagtccgtcaggtggtacaagtacaaacggcggtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatgccaacaagtacaccaacaaccactactacaccaccaacgacaacagctgtagtcaccattggcacgaaaaatgatttaaccaatatcacctcgatttcctctaaacctaaagatggaagtacgggcggaaatggtgctggctcaactggagacgtgactaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctattaccattaacgcaggttctgtaccagctactccaaacagtccagcacaacctgctgacccaagcttgcctgctgttgataacggaccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgcgagcaggtgtggctcaagctgttgcacaagcgaacttaccgatcaatatattaccgggtaaaagtacgttaagtttggcgaccggtaactatatgggtacgcaagcctttgcggtaggttattccagagtatctgataatggtaaacttagcgtcaaattcagcttaggacatggcgataagaaaacttctgtgggtgcgggaattggttatagctggtaattctggacttttcatccatcaaaaaagggcgtttatacgcccttttttctattagtgtcgatattttttgtcaatctaaccgcacttttcgtaaatactaaattaatttaagcaatacctttatgtcgcagtagtgcatctaattgaggctcacgacctctaaagcgtttaaatagaatcataggttcttccgatcctccacgagttaaaatttcatctaaaaatgaacgacctgtttccgcattaaaaattccttcttcttcaaaacgggaataagcatcggcagataaaacttcagcccaaagatagctgtagtatccggcagaatatccgcctgcaaaaatatgactaaagctgtgaggtgttcttgcccaatccacacctttgatcaccgcaacgtcagatttaacctgttttaaggtcgctaggatttgatttggtttattagcttcaaaataatggtgtaaacggaagtcgaataaaccgaattctaattgacgtaaaacaaacattgccgcttggaagtttttcgcttttagtaactgctctaatttttcttttggtagtggcttgccggtttcataatgtcctgagatgaatgctaacgcctcttcttcccaacaccaattttctaaaaattggcttggcaattctactgcatcccaaggcacaccattaattccggcaacatcagcgacatcaatttttgtgagcatatgatgaataccatgtccaaattcatggaatagagtagtgacttcgtcatgggtgaataaagcgggtttgtcaccaatcggagcattaaaattacaagtcaggtatgcaacaggtttttgaattgaaccgtcagctttacgttttcgtccaatacaatcatccatccaagcaccgccacgtttattttctcgagcataaagatctaagtagaaacttcctctcacttcatttttttcatcaattaaatcaaagaagcgtacatctttgtgccaagtgtctacaccaaaacgctctactgctcgaatattgaaaattcgtttaattaattcaaatagacctgaaataacttgatcttccggaaaataagggcgaagttcctcatcattaattgagtataaatactgtttttgtttttcgctataaaagctaatatcccaaggttcaagtgcggtgatattgtaatttttttggcaaaattcttgtaattcggtcaattctttctcgccttgattttttgaacgttttgctaaactttccaagaaatcaataacttgttgtggagtgtccgccattttggtcgcaagggaaagctctgtataagtattaaagcctaacaaatgagcaagttctacacgcaaagtcaaaatttcttgcataacatctgtattatcccattttcctgcatttggtcccagttctgaagcacgagtagcaaaagctcgatacatttcttctcgtagttctcggttttcacaataggtcatgacgggtaaataactagggaattccaaggtaaaacgataaccatcaagccctttagattgtgcggattgttttgctgcttgtaatgcactttcaggcaagccaattagatcttgttcattttcgacgactttatcccatcccattgtcgcatcaaggacattattactaaatttagcgtttagttcagataaacgagcaacgatttcaccgtatctttgctgtttatcttctgataaggcaatacccgataattcaaaatcacgcaacgcattttctatcgctttcttttgtgcaaccgtatattgggtaaattccggactattttttagttgtacataggcattatataaccctttatgttgccctaaccaagtactatattctgaaatcagcggtaaacaagcttgataagcggcacgcaattcaggactgtttttcaccgcatttaaatgagaaacaggcgaccaagcacgaccaagtttttcctctttatcgtttaggggttgaataaaattctcccatgtaaagtgcggttgttttaacacttgttctaccgtttcacgattttgttggatcaattgctcaatcgccggttgaatatgttcaggtttgatttttgaaaattgtggaagttctgaatgagttaatagtggattagacataagtgttcctcaaaatagacagttattttatataaaaaagtggtaagtagattgggatttattctggaaaatcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcgaaagttcgatattattaagggaaaataaatgactaacacacaaaaatattaccgcattgctttattgttcaacgccaataaggtgtatgatcgagaggtggtggctggtattggacagtatattcaagcatcgcaatgcacatggaatatttttgtggaagatgattttgtttaccataaagaaaccattgaacgactgtctattgatggtattattgcagactttgacgatcctgaaaccgtttccttgttgaaaaatattgatgttcccactattgcggtaggtgggtcttatcagaattttgctgattatccgcacttcccttatgtcgctactgataattacgctttagtcgaaaccgctttttcccatttaaaacataaaggaattagtcaatttgccttctatggtttgccgactcaagacactcggcattgggcaaatgagcggaaaaatgcttttgtagatttaatggaaaaatatgcttatcaattttctgtatatttaggtgataaaactgattcaggcagttggcaagtggcacaatcggaattatgccaatggctacaaacattgccggcacataccggcattattgcagtaacggatgcaagggcaaggcatttattacaagcctgcgaatatttgaaaatagccgttcctgagaaactttgtgtgattggtattgataacgaagaattgatccaatatttatctcgcatttctctatcgtctgttgctcaaggtaccaaacaaattggttatcaagcagcgaaaatgttgcatagtctgttaagtggacataaagtgagattacaaccaattttaattcctcccttaaaagtagaagaacgggcttctacggattaccgttctttgcgtgatccttttgtgattcaagcaatgcattatattcgccaacgagcctgtcatggtattaaaacagagcaagtattggattatttaaaaatttcccgttctaacttggaacaacgtttcaaattggaattaaacaaaaccgttcatcaaattattcatgaagaaaaacttaaccgagccgtgtatttacttcgctttaccgatatttctatgccagaaattgctgaaatctgcggttatccttctttgcaatatttttatgcagtaatgaagaaagcctatgggataaccccaaaggcttttcgtcgataaattactaaagcactaatgatttagttactgattgagtaaaatcagggttgaaaatctaaaaaaaatgagaataattgaaaactgtttttattttattagtaagctgtatgaaaatcgtttatttaagttttggttttatttttctcgcattaggtattcttggcattattatgccgggattaccgggttttccatttttactcttgactattttttgttttagtcgaagttcggagcgtgtgcataattggtttttgcagacagaaatataccaaaagcatgttctaccttttaacgaaaatagggggatgcgtaagaaaacaaaatacaatatcttaatttttgcgactattatgatggcaattgctttttactttacacccagtgcggttggcaaatcgatcattcttgttgccttagtcattaaatattggtatttcttatttaaaatcaaaaatttaaaaacgtaactgatcttgtttacgtgtttttgtataatgtctcaaataatttaaataagtaacaaaaatgcctttttatttccttcgtgtttatctgtttttattgctaaaaagtgcggtgctttttagtatgctttttttatctgcttgtaatgaaaaacaagaaaatattaagactgaagtttttcaacataaacagtctgagcaagttcagttgcaagaaatagaaaaaaagcaattaacacgaggtatttatgctgagttggtcgtagatcctttgttgctgaaagaagaaggacaggcagagattttgcgtgatattttcgaaggattaacaggctacaatacgcagggtaagattattccggcggttgcagaatattggcaaacggaagacaacaaaaactggatttttgtgttgcgtaaagatgcaaaatggtctaacggcgtcaaggtcatcgcacaagattttgtggatagttggcatagactggctttatctgataatccattgaagatttattttcgtctaatgaatgtcagtaatgcggaatcagttttaaataaaatgttaccggtagataaattgggggtttttgcatcaaatgaacgcttattacatattcaacttgataaaccgacaccacaattaccggccatgttgacccatgctgttttattacctcaatatcaatcaacagataatgaatttataacgaatggtgcttatcaaattgctgaacgacaagaaaaacaaattgctttagcaaaaaatccttattatcgagaatcggaaaatgtttattttgatcgagttatttatcgagaaatttcccaaaatcaatcgattaactctttagatttcgttctgaatgcaaaatcatcgcaggaaaacttaatttatttgccccaattatgtgtttatttttatgagtttaatttttctcacccccatttgaaaaaaagtgcggttcgtagagcattaatttcaatggcaaccattccacaaacttttttttcagcgaaaatgcaagcaattcattcttttttgcctcattctttgcgattaggacaagaagacatttgggagccgactattgtggaaaaattattcgcagaaagccaaattacagaaaaatcgccgttaaaattcacgttaacttacgataaaacggaaatacaagaaaacattgcaagaaaatttattcaacattggtcgcaatcagatttaattcatgtaagagcaaatccggtttcaagagaagaattattgcaacaacgggcaattggtgattttgatattatccgttcaggctggtgtgcagattataaggaaccgtcaagttttttgcttaattttcattctaagagtccggacaataaaacaggctaccaaaatcctcaagtagatcaattactggaaaaagcgttgcagtctttagaagaaaaagagcgtaatattttgtatatggaaataataaaaattttgcaacaagagcaagtggtattacctatttttcagcctcttatccccgtttggcaaaacaacattttgggtattgaacagaacaatgacagtggtgtgatatatagcaaagatttgtatcgacagaacaaagcaagcgaataagaatatcttatttccgcataaataacctatttaacttttaaacatattaaggaattattgtggcattagtgagtttaaccaatggctatctttcttttggtgatcagccgttattagattgtgcagaattacatattgaggcaggtgaacgagtttgtttagtcggtcgtaacggtgcaggaaaatcgacattaatgaaaatattggcacaagacgtcatgatggatgatggacacttgcaatttgaacgagatttgattgtgtctcggttacctcaagatccgccaaactatgcagaaggaaatgtgttcgattatgtagcggaaggtattggacatttagctgatttattaaaagattatcatcgtatttctctacgattagaaaaagaatacagtgaaacattgcttaatcaattagcacatattcaagctgaactggaacataccggcggttggcaatttgaaacaaaaattaaagaaattctaactaaattagatttgaatccagatactttattaaatgagctgtcagggggtggctacgcaaagttgcccttgccaaagcgttagtttgtaatccacatgttttattacttgatgagccgactaaccatttagatgttgacgcaattgaatggctcgaagaatttttattgacctttagtggcagtattatttttatttctcatgaccgctcttttattcgaaaaatggcgacacgtattgtggatttagatcgaggtaaattagtttcttatccgggaaattatgatttgtatttaacagccaaagaggaaaatttacgggttgaagcactaaaaaatgaactctttgacaaaaaattagcacaagaagaagtttggattagacaaggaattaaagctcgccgaactagaaatgaaggtcgtgtaagagcgttaaaagcattgcgtgaagaacgtcggcaacggagagaggtactgggcaaagctaaactacaattagataattcaagtcgctcaggaaagatcgtgtttgaattagaaaatgtttgttatgaggtagcagggaaaaccttgttaaaagatttcacaacgaccattttgcgtggagataaaattgctttagtcggtgtaaacgggtgtggtaagacaacgtttatcaagttgttgttgggagaaattaaaccaacgtccggaataattcgttgcggtacaaaattagaaattgcttattttgatcagtatcgtgccgatctcgatccggaaaaatcggttatggataatgtagctgatggcaaacaagatattgaagtgaatggtattaaacgccatgttttaggttatttgcaagatttcttatttccgcctaaacgtgctatgacacctgtaaaagcactttccggcggagagcgtaatcgcctgttgttagcaaaattattactcaaacccaataatttattaattcttgatgaaccgacaaatgatttagacgtggaaacattggaattgttggaagaattattggcggattatcaaggaacacttttaattgtcagtcatgatcgtcaatttattgataatacagcaactgaatgttatatgtttgagggaaatggcgttctgaataaatatgtgggcggtttttttgatgcaaaacaacagcaagctaattattttgcttgtaaagcagaggaacaagttaagcagaaaaaacatgaagaagagaaaagaggcgtaaattcagtcgttgagaaagcagaatacaaaactcgccaagttaaattatcctataaagagcggcttgaactggaacaattacctcagttgttggaagaattagaagaaaaaatcaccgcccttcaaacggaaattagtgatgtagatttctttcagcaaccgcatgaatatacatcaacaaaattacaaactttagcagatatggagcaagatttagagacggcttttttacgttgggaagaattggaagaaaaaaagaatttagctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaatcgcttcttactaaatctctcatcgcttcagcgttggcattatcagcgagttatgccaatgcggcagctttccaactcgccgaggtgtccagttccggtttaggacgagcttatgcgggtgaggcagcgattgctgataatgccgctgttgtggcaaccaacccagcgttaatgagtttgtttaaaacgaaacaattctcaatggggggggtatacgttcaatctagaattaatataaatggtgaggttaatgttaatgtagggaagggaattgtacaagttgcagatgaaaaagcagatcagaaaaaggttgtacccggtgcattagttcccaatttgtattttgtggcacctattaatgacaaatttgctatcggtgcgggtatgaatgtcaactttggattacaaagcaaatataaaaaggattatgatgccggtgtttttggcgggactactgagctgaattccattaatttaaatttaagcggttcatatcgtgtcagcaaaggattaagcgttggtgcggggttaaatgcggtttatgcyaaagcraaaattgarcgwcawgcrggkgttytagataaggcaattgatactattgcygattctaakggaatgsytgggagkatcaatattccttcattrmmrkcrttagtcccmattttytccmarttaaaaratrgagtsaatrcggatacymycttaacacaattacaagataataatgcatggggattyggttggaatatcggkgcrgtytatgaatttaatcaaggtaaccgtatcggtattgcctaycattctaaagtagatattaattttaaagatgatgatgcgttgagttatcaatttgaagcaggaaaaattagtcctgttaaagagaaaggtgggttaacgctacatttgccggattatttcgaaatttccggtttccaccaattaacggaaaaattcgccatgcactacagctataaatatactaaatggagccgtttacaaagtttacatgccacttatgataacggtaaggtcgctttccataaagatgaaaaatttcatgacagttcacgtgtagctctaggggcgacttataatgtgaatgataaattaaccctgcgtgcaggtattgcttatgatgagtctgccgaccatccgagtgcttcaatccccgataccgaccgcacttggtatagcttgggtgcaacctataactttacgcctaatctttctgttgatgtaggttttgctcatttacgtggtaaaaaacagcaatttaaggaaaagcataagattggaagtacaggtattgagttcggcagtatagatgcaaactataaatcaacagcacgtgccaatttgtacggtttaaatcttagctaccgtttctaacggctatccgattgtttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcggcttcaagggctaaatgatagctgatgacttcacgaattttacgataaaacaaggcacttgaatttggattgatacctaaaatattagctgctgatcgagctgtcacttctaacacaaaaaactcaaggagctttttctgtatagatttctttaatttacaatgagttattttcatttttatagactagcatacttactaatctaatacagccccatattttaagtnnnnnnnnnncaagtttcggtttacttgcaagcgttattcttccaaaatctctgcaaaaatctgaatccctttgactcctagtgcggtggctagcccaacgaaatccgctccagcggttttcattcgttcaaaaccggctttgtcattaacaccgcccacaccaataatctgtacgtcttttaattttggttctttatccagcatttgacgcagagtatagacattgcctaatgataatgcgtgaattgctgttcctgccagtcctccaatgcctgttcctgtttcagaatttaatatggattttccctcttgcatcactaatgaagagccaagcgtattagtagaagtaataaaggaaatcggtagcgttttattttctgttagcgattttaatagtccattaattaattcatcatattggttttgataggtaaatggtggaattttaatgccaatcggtaaagcctcttctcctagacttaacttggctaaagtggtttgtaacgcatttaaataaggtaataactcttctgcggcataggcaggcgaaatttttccgggcatattggggcaagaaatatttatttccattgctaagggcatcttcacttctgtttgtagcgtcacgatttgctcatagcattcccctacttcttcaggtgaaccaaacacggaaataatgaaaggcttgttggaagtggtttttaattcatcggagatagtacgaacaaagcgaatggtagtcgctaaattattgggactaagtccaattgtatttaggctggtggtttgttgtggagtagcattgggggtattaacactggctgttttttgtgatgttgaatcaaataatacatattggttttttgtccagtcatgtggatagggaactagcatagacgtgcgagttgtaaccgcacctgtatattgacaagcataaagttcacgtaaattttctaattcggaacaccaagggcaaggggtatttaatagggcagggtgaatgttaagttttttcattttggttttctccataattagatcatagttaataaaaaaggacgctataaatagcgtcccggtaagttaagattaattcttttcagatgtaacaaattcaatagaatggtaactgaatcacaagatttgatgttttttaatgaaaatttatggatatatattaacatgttgctgatgcagaaaaaacattaccatagaaagagggttgaacgtggttgagaaagtcaatcttttatttatacaagatttctaaaccacgttattaaactggggcggtaatataacttatttcagcaaaaatgagaagctaatttagctatattttatctaaaaattttagggtattagaattcagtcaaaattttatcctttgaaagagggtaatatgttaaacatcgacagaaaatggaaaagtgcggtaacaataccaaatagaataaccagtagaatagtgacgtttccgcctgcaaccataaatccttgtttaccattaggtaattgacgtgatttgtaagccaataatgcagggataatacaagcccaaattgttgccaccgcacctgcataaccgatagctttcaaaaaacctaatgggaaagcaactgataatattaatggaggaaggaaagttactgcccaagattttgttctccctattttgttgtcatcaaatttaaataagtcagccaagaagtcaaatacacctaaacctacaccaatgaaagaggatagaattgcagcaatggaaaaagcattaatagcttgtttaactgatgcggattcaattacatttcccaaagctttgagtaacacatctaaattgccatcactggcaataattggtgaaaattgatttcgtggcagattaccaaaaatagaaattacccatagtaaatagagtgcaagagcaatggtggttccgcctaaaatagctaatttggctttatgttcatttttatagtatgcacgcattgttgcaacagagtggtgataaccgaaagatgttaatgcaacgggtaataaacccattgtgtatatgacatagttattatctgagccagtatttgtattaaataaaatggctaagtcaatatttttagttaagccaaatacactaagcataaaggaggtcgtcataaaaataattaatataatggaaatgcgatcgacaatgcgagtagaatgccaaacaaagaaagagaatatcaaaacgaagataattgaccaaactcgagagtcaatgttgaacatttcatttgttaatccacttaggatgccacctgatgctgtagtataagcgtacagtaaaatacctccaacaaaataaacggataaattgttgatgatgttgacagtattacctaataggcttttggttactgtattaaaagaagctcgtaaatcaaaatgtttataagcctcaagtaataaccaaccggataacgtcatgcaagtcatcgtaaatccaatggtgaggacagaccaaatagtccaagctcctgcaccggatgtaggtaagcctaacattccggcaccgacacagacactcgcaataatgcaagcaccaccgaaaatagaaggtgatttttgcataatatagctccttttgaaaactataaaaaaacaccgcattttttgttaaaagtgcggtgccaaatttaaatctcttttaatcgagcggtgaaatgacgcagtactttaggttcataagtgaaatctaaacctttgatattttttgcattctctttcactcgtttgaatgcttcaataatgaagtccatatgtgtttgagtgtaggtcgcacgaggaatagttaaacgtaacaattcagccgggcaaggtaattgttgacctgttttcggatctcgtcctaataggagagaaccgatttctacggatcgaatacctgctactttatataattcacaagcaagagcctgagctgggaattgttctgctgggatatgtggtaataatttgcctgcatccacaaaggcggcatgtccaccgggttgttgacaaacaacaccgatcttttctaaaccttgtacaaggtattcaatttggctaatacgataagctaaccaatcttgacgcataccatcacgtaaacctacagctaggcgttccattgcaccaccttctagaccaccataggtagggaaaccttcttgtacaacacaaagtgtacgacactcgttgtaaacatcttccattgaattatctttgaagcagagtagtccccccataggtaccattgcatctttttttgcagacatagccaaggcatctgcatatttatagctttcgtaagtgatttgttcaatagtccaatctttgtattctgcttcacgttgttgaataaagtaggcattttcagcgaagcgagccgaatccataatcacaggaatatcatatttacgtgcaatttggtacatggctttcatattggcaagagataccggttgtccaccggcagaattacaggtaatagtacatacaatgtaaggaacattatttgctccaacttctaaaataccctgttccagtttttctaaatcaaaattacctttgaaatcatgatctacatctgtgtcaaaagcttcttttatatagacattacgtacagttgcaccatttaattggctatgaccttgagtagtgtcaaaaaaatagttagagaaaacaaccattttatttctatccaaccctttttcttgctcacgttttttgatcaagacaggaatataaatttgttctgcaccacgaccttgatgggttggaattgtgtattcataaccaaagatttctttcactgcattggcaagagcatagtaactgcgacttccgctataagcttcatcacctcttagcatggcagcctgcatatcttgagtaacggcacctgtaccactatcagttaatagatcaataaaaatatcttcactgtctaataaaaatagattcatacctgcttttaagatagcttcatcacgataggcacgagttgtacgtttgacaggttcaataacacgaatacggaacggttctggtaaatgtttgaaattttccatgattaaatcctcaaataattaattaaaaaatgtatattacaaaaatattattaggattgaggagttatgggaaaatacagggatagctttggatctacaagtatccaaacttgatttggtgataaaacatttaccatagcttatccctttttagaaatgaaatgtaatttatctcagacgaggaagatagtaacttagcaattgcactttgtcatatagaatgttttaaatttgtgaactaagtcaaaaattttgataaaaaataagactctacttatagagtcttatttttatgaaagtgcggtttgtttccgcaaatttttattgtgtcgcttgaattgcagttaatgcaatagtatacacaatatcatcaaccaatgctccacgagataggtcattgaccggcttacgcataccttgtaacatcggaccaatagagactaaatctgctgagcgttgtactgctttataggttgtatttccggtattgagatctgggaagacaaatactgtcgctttaccggcaaccggagaatttggtgctttagattttgctacatcttccattactgctgcatcatattgtaatgggccatctattaataaatccgggcgtttttcttgggcaatacgagttgcttcttttactttctcaacatcagcaccggaacctgacgtgcctgttgagtaagagatcatcgccacttttggatcaataccgaatgcttttgcggaatcagcagattgaattgcaatctctgccaattgttcggcagttggatcaggattaactgcacagtcaccataaacaagcacttgatcaggtaataacataaagaagattgaagaaacaattgagttaccaggtgctgttttaatgatttgcatcggtggacgaatagtattcgctgttgtatgtatcgcacctgaaacaagtccatcgacttcgttagcctcaagcatcatagtgcctaatacgacggtatcttctaattgctctcgtgcagacgtttcagtcatacctttggctttacgtaattctactaaacggtctacataattttcacgtacagagacaggatcaattattgtaataccttttcctaatacaacgccttgagcatcagcaacacgtttaacatcatcaggatttgctaataagatacattctgcaataccacgttctgcacaaagactagcagctttaactgtacgaggttcatctccctcaggtaatactattcgttttttggctgcacgagctaactcagttaattgaaaacggaatgcaggaggagataaacgacgaggacgagttgaggcggcaactaaattttcaataaatgaagatttaaattgttggcttgtgtattgtttaatgttttcgatgcgttctttatcatcaacaggtacttcaaggttgaagctttgtagagccaatgcactttgccatgtgttaccttcaattcgaaaaataggtaagccggtattttcaaatactggttggcatagttttttaatttgattgtcaattttgtaaccacctgtgagtaaaataccacctagctcgatcccgttagtcgcagcaagtgcggaggcagttaggacatcaggacgatcagcggaggtaactaacagactacctgttttgaaatgctcaaccatattttgtaatgaacgagcacagaaagtaatactacgaatacgacgagttttaatatcgccctcatgtagaatagaagcacctaaatgattgaccaaatcaatagcacgagttgcaataagctccgcattccacggaacgcaagctaatactttaatagggcttttttcaaatagcttgtaaacctcattaaggttattttgtttatgttggtaagcatcaaaaatttcacttaggtctggacgagtacgtccggattcatcaattggtgcattaaatttattaattatgacaccaagtaagtttggattattttttccgccaaattgagaggctgccgcttcaatgcgttcttttaactctgccggcgtttctgttgcaggtgctgcaactaatacgatttcagcatctaacgcctttgcaatttcgtagttgatactgtttgcatagccatgcttgcgagttggaactaagccttcaacaataatcaattcattatttttagctagttgttgatgattttcaacaatcttttccagtaacacatcggattgattttgaccgattagattttcagccacacttagcataaacggttcggctgtttcaagtgttgtactggtacgcacaattgaagtagtgcggtctaatttatcttcatcggtacttggttgcgaaattggcttcatgaaaccgatttttgcccctttttgctcaagagcgtggattaaacctaaacttacactggttaaaccaacaccggtgctaataggaataaggataattgtacgagacataaaaaaaccttaaataatgttgttaaaaaagaaactgccgaatttatcggcagcctgtagattacaattagaaacttaaacgagcagtatcttgtgcaattacaagttcttcgtttgttggaataacgattgcgattggcgtattatccgctgtaataacaccttcattaccaaaacgagctgctgagtttttctcatcgtcaattttataaccaaatagttttaaatgatttaaagtaatttgacgaaccaaggcggcgttttcaccaataccgccggtaaagacaatcgcatctaagttttcgccaataatagccatgtatgaaccgatatattttgctaaacgatagcagaatacatctaatgcacgttttgcagcactttctttttcatagttatcttcagaataacggcaatcactcgtgacttctgttaaacctaacaaacctgattttttaactaaagtttcctcgatctgtgctactgacatgcctaacgtattgtgcatgtaaaaaatgattgctggatcaagatcaccggaacgagtacccatcaccaagccttccagtggagtaaagcccatggaagtatcaatacatttaccttggcgaattgcagcaacagaggcaccgttgcctagatgacaggtaattacgtttattttatcttcagcaatatttaaacgtttggcagcttcacgactcacgaaatagtggctggttccatgcataccataacgacgaacgccatgttctttgtataaagaatatggcagagcgtataagaatgcttcttctggcattgtttgatggaaggctgtatcaaatacggctacgttattatcttttaaatgaggaaatgctttaaatgcttcttcaataccgatcaaatgtgcagggttatgaagaggagcaaattcagcagcatctttaataccttggataacttcatcggtaataacaacagatttggtatatttttcacctccatgaacaacacggtgtccaatggctgcgattgaatttttaagatcttcagttaagatagttgaaacgataaagtttaatgcttcactatgtgctgcaccagcacctaaatctgcattacctttctcaccgttaagtttccacttaattcgggcatccggtaggtagaaggcctcggctaaacctgataatttttcagcacctgaaactggatcaagaatagcaaattttaaagatgaactaccgcagttaagaattaggactaatttttgagacatacgagacctattttgaaagttaagttaaaaaataaattcatttactcaacaatattccaagtaaatgaactgacatgaaagtctttgccctgcatagaatacacttttcagataataaaataaattggtaaaatcaaaaaatacgacttttatcaaaaaatgtatcaaactcatcgtttaattttcttgataaaaataatagatttttttataaataattctaaacgaatatgtatcaaacactaaaattaggtcaacgttatttggaaacttggccttcaatacctaaactgagtattatttttcctgaaaatcgagttattaaggtaacattatttgcacaaaaatttatgccgtttttagcagtattttcattagtttggcaacaagtttatataaaacatgatttggttgctttagctattgcagttttaaccgctttgtttgcgttgagcttgccattacaaggtctatattggctaggtaaacgctcaaagttgcctttacctccacaaacaaaggtatggtttgataagatagttgaggtgttacagcaaaaaaatactaatcttgtttctattgagcaaccaacgtatcaggatttggcagagttattgcgtaaggctgaacagaaattagatactgagttttggcagagtatttgagcgaagtttatcgctaaacagcaagtgatatatctaatgggttgaatatagtaaaattttccccgcacttggttatcaagtagcttattttttcactatataaggaaagaaaatgctttgtgctatttacaagactaaaagaaaagaagggatgtatctttatattgaaaaacgggggcattttgattccgttccatcttccttacttgagtcattcggcaagccaatttttgtgatgttatttaatttagcaggacaaaaatcattgattaatgctaacaatgaagatgtgcaacaacaaattaaacaaaatggattttatttgcagatgccaaaacagcaagaaaatttacttgaacaagaaagacagtatcttaagcacaataaatgacataatcaatgatatgattttttaaaatttttaccgcactttgacacttttgaaaaaataaaggcgatcatagatcgccttaaatgtataaattatgctacacagactgtttcggttggtcaaataccgtcactttcggtgcagtttctgtgtatttttccacttgaacaatacatgtattcggggaattaccttgtgctaattttgaagtaccttcatcacgtgtcagtacgttggcacaaccatttttacataaaggttgttctgattgacctaaatcagccggatcataccaagccccctcatgtaatgcgaccgtacctttaataattccttcagtaactaccgcacctgccaatacttgtcctcttttgttgaaaatacgaacaatatcaccatccatgatgccacgagccattgcatcttctttatgaattagcacaggttcacgatcgtttactgcatattttttccgtaatgatgtgtgagccaattgactgtgtaagcgatagtaaggatgtggtgtaactaatgctaaaggggcttccgtcgttgtattacctgcaaattcttcaggaacaaaccaatatggatgacctttacaatcatcataattcatttttgcgacaacatcagagtaaatttcaatttttcctgatggtgtaccaagtggattcagtaaaggatcattgcggaatgcttcgtaacgtacccatttttttgatttttcagttggtttaaagttaacaggtttattttcttgccagaatttttcaaatttcggcataagtacacgatttttacgtgctgcattaaatgccacgttgtaaaaatcttgcaaccattccatttccgtttttccttcagtaaatttgtcttctactcctgcacgtttggctaattctgcaaaaatatcatagtcatttttcgcttcaaattgtggaggaacaacttgtttcattggaaaaatattcatcatggcataatcaccggacatagttaagtcgttacgttcatagctcgttgtggctggtaatacaatatccgccatgcgagcagtcggtgtccagttaacttcattgacaataacagtttcaggtttttgccatgctttcactaatgtatttgtatcttggtgatgaacgaaaggattaccacccgcccaataaattaacttaatgtcaggataggtcactttagagccattataatcaattgtttttccgggattcagcaatacatcagcaatacgtgctaatgggaaagagaattttgatgtatcatcaagccatgttttttctccggcttgtactgatggattagctgtaattgaaccaataataccaccgactgcggaaggtgcaccaccattagaataatgataactgaaaccaaatccgcctccaggtaacccaatttgtcccagcatcgccgctaaagtaactaatgtccagtgagtttgttcaccatggcgttgacgttgcataccccaaccgcccattaacatagtacgttttgacgaaaaatcagcagctaactgtttgatgatatctgcaggtaatccacaaattttgcttgcccaatttgcgtctttcggttgaccgtcagtttttcctaataaatattgttcaaatttatcatagccagtagtgtattttttcaagaatgccttatcatgtttatctgtagtaaccaacgtatgtgcaatccccaacattaaaggaacatcggtgcctgtatgcacaggtaaccattctgcatttaagaattcacagctttcacttctaaccggatcgatacaaataatacgtttaccgctttctttcaattttttgaaatattcaataccttgttgatcggtagaagtccatgcaattcgcaaagtcgtaagaggattagccgcccataacacaacaatatctgaactttctaaaacggtttcccagctggtttgttgttcataaacttcaattgtacctaatacatgaggcataattacttgtgccgcacctgttgaatagtcccctttgactccgacaaatccaccggtaacattcatgtaacgctgtaacaaagtacggctagcatgtaatgcacctgagctataccaaccataagaaccggcaaaaataccgcctgcaccataagcatcacgaacacgtttcatttcacctgcaactaactcaaaggctttatcccaagaaacacgaacccattcatcacgtccacgcaaactggtatctttattaccctccaaaaatcctttacgaaccattggatattttaccctcgtttcactataaagttggtcagctactacgctttgtaattcattttcgactgaaattggcattgcagatcctgatttaactaccttgccattttctacaactacacctaaagccccccaatgagcagctgttacaacggtatgttgttcagccgcaacagctttcgaagctaatgttccgacaacaccgccacttagagatacgccagccacgcctaatgatgaattttttaaaaaatcacggcgacttgtattaactttattttgtgttttcattttaaacctcgttatttactaggctcacaatgaactggtgaaagaaaagacatcgaaacggttagaaaacacaccgcactttctccaacacattgtgaaagttttattttcgacacctttctaaagggagtggcacaaccatttctagttataccatgtgcaacatttgacaatgttacaggcttgcaaccttattttgcaacttaggtcaacaagctcggagtcgtcagttttttcaaaaatttcagcgtttccctcaagcttggcttaatggctttttccgccgaaatctttagcattgcgttgtaaatagattgttactgaacgaatatcatctgctgtcattgatgtacgatctttcatcgaatttaccacgccaatccattgatttgcggtgtaatgatctgccccgatcggtgcatgacaaccgctacaatgagtttgatttaaattatgaccgaattgatttaatgcctctaaattggacgtgagcatattttttgccacttttacttcaatcgtaatttctttccaatcagaatccgtgacgttgtcatgaacagtttgtaatacggtcgcatttttttcaattccatcacctaaagccaacataatgcgttgccctaattgtgcatagactattgtttccgcccctacttgttgccagccgtgaattgtgccgataacattgtcatcttgcaatttccaatcattcacttctgcaaacggcattaaccgcacttcatcgccttgtgccagctgtgccggactcattgccaaactatataatattttatcggtttgcttaaattctcctgcatgtttagttaattcaccatatgcggctgtatcatcaacctctatttcaggcataaaatgagcaatacctttatggcaatcaatacaagtttgatttgtttcgatgccggttttgtgcattttttgtgctgtcggtgtttgcgaagacatttccattgcttcgaaactatgacaactgcgacaagtggcagaatctgattcttttaaatcttgccaaacggacttcgccatttctaaacgatgcttttcaaatgcttcttcatcaggcaatttatcagtaacataagtatgccaaagatctttcactgcaaagacttttgttttcacataatggaaaacgttatcttgcgggatatggcaatccgcacattcggcacgaatcccttttcggttagagaaatgtatagaggcttcccattctgcttgaggttgttgcattgaatggcaagaaacgcaaaattcagtggtgctggttgctttcattgcatactgtactcccgctaaaataatcacccctaataacacaccaacgattccactaaacagccattttttatttgattttgccattcgcgtttcccccaagaataaaattcaataaatcaattacaacaaaaaaatcatactcttatattgtaacgatatgatgttggtaattcactaggcatacacgaaaaataacggctatttgcaccattcttgacgtagatcaatatttaaatttaagagtgaatatgtgaaataaaatgcgtaattttatgtggcatttttagtattttctcccataaattgaaaggattgatatggtacaattttgttttttatcttatgcagaggaaaaggataggttcttttttgtgccactattaaggttaaaggagaaaagcaatcttgttgttttttttcactcaaattgacttgatcgagtatttcaaaatttaataattttatccaatcaaggatacgccaagtgaaatattgtttaaagggaagtgcggtttgatttttatgatttaaattttgtttgaaaattaatgggctataagggttaaataaggaaataaagagataaccgtcattttctaaaaccctggctatttcacctaataattgatgggaatgttgcgtgaagtttaatgtattggctaatacgcaagcgtgaatagattgttgtacaaaaggaagttgtaatggatcagcttgtatcagactaatttcttctgttacgttttgattagctggaaaaagtgcggtaggatttttcgtcatttccggcatgaggattattttgtggcgtaaaggtaaattgagttctaattctgcacttaatccgccaatcatgagccactgatcgcctaagactttttgaaaccaatctgcaaaaaattcgttgattaggctacaatacattgttcctttttggatatgttgccaactcatcggcaatcgataattttttactgattttatgttgaatttcatattttctaacttgataccctttggaggagcttgatgttaattcctattcctgcacttaatgataactatatttgggtgtataaacgagagaatttatctgtaattgtgatcgatataccggaaatagctgcattatctcaatttatacaggcacaaaatttagtgattggagctttgctgatcacacataaccatagggatcatattggtgctttggctgaatttaagcagttttatcctcatgttcatatttatggtccggcagaatgtgccgatcaaggggtgacacaagtcattgatgcaggaaggttaattattgatgaatatcatatagatgtattaccgactggcgggcatacggcacagcatcttagttttttgatagatggtcatttattctgtggagatactttattttctgccggttgcgggcgtgtttttacgggagactattcgcaaatgtttacttctttacagttactcaaatccttgccggatgaaacaatagtttgcccagctcatgaatatacgttaggcaatttagcgtttgctttaactacaggcaaaaataaaagtgcggttcaaaagcaacttgaaaaagtaaaaaaactaagagcagaaaataagcccagtttgccgacaacattggcattggaaaaacaaattaatccgtttttacaagttgagagccttgatgagtttattgaattgcgtaaagcaaaagatgttttttaatttaaattagacattctattgtattaataggtaatcgaatttgctcaatgtgggacaatttattagaatagccacgttttttacatgaattttccaacaataaattatttatgaccattcttgttctcggcattaatcataaaactgcctctgttgcactgcgagagaaagttgctttttctgacgaaaagcgtttgttggcgttgaagcaaattaaacaaactcagctggcagaaagtgcggtgattttatcaacttgtaatcgaacggaagtgtatttacataataaaaatgttggacctcaaaatgatgaagtctggttagatagttgtgttcaatggtttgcagatattcatcaagtagatttagaagaactgaaaagttgtttatatagtcagcagaatttacaagcatctcgtcatttaatgcgggttgcttccggtttagattctttaattctcggtgagccacaaattttaggtcaagtaaaacaggcctatcaaatgagtgaagagtattattcactgcattctgatattggcatgatgagtactgagttatctcgcttatttcaaaaaacttttgctacggcaaaacgagttcgtactgaaactcatattggagaaagtgcggtatcggttgcttatgcagcctgtagtttagctcgtcaaatttttgatagcttacgcaatttgaatattttgcttgtgggtgccggagaaaccattgaattagtcagccgtcatttattgcgtcatggagtgaacggcttagctattgctaaccgtacgttatctcgtgcggaaaaattggtggaaaaactggaaacaacacaaaagatagatatttttagtttagacagactttcggaagggttaaagagagcagatattgttattacctctaccggcagtcctcatgttttaatctcccgaaacttgattgaacaggcacagcaaatgcgtcattacaaaccaatgctgattgttgatattgcggttcctcgtgatgtggaggaaagtgcgggggaaattgaatctgtatatcattacactgtagatgatctacataatattattcaacataacatcaaccaacgtgaacaagcttctcaacaagctgaacatattattcagcaagaaagtgcagatttctttgaatggcttaaagtacatcaattttctaatttgattcgcaattatcgagaaagtgcggagataattagacaagatttactcgaaaaagccttgcaggctctgcaaaatggtgagaatacagagcaagttttacaagagttgagtcacaaactgactaagaagctgatccatcaacctactcaagctatgcaaacgatggtaaaagccggtaatacagaaggtttacaggctttttctcatgcagttaagtcctaggaaagtacaatttatttaagtttatccagttttgccaataaaataggtgctggttgttgttgaattttatacatacgccaaagcagtaaaatagcagcgattgttaaactcactacaaaagatacccaaaagccggcagcaccgatacttggaataatccagtcggttcttgataaggaaaatcctaacggcatgccaatgccccaataacaaaaaagggtaatgtataaaatagcttgtgtatctttatatccccgtaatgcaccactggaaactacttgagctgtatccgaaaattgataaagtgcgacgatcatcagcagactacttgatatagcaatcacttctttatcatttacaaaaattgctgctatttcatagcggaagaaaaagatgatggatgccgtcaggaaagcaatagataaacctacagtaagagcagagaaagatatctgcttggcattatctattttgccttcgcctagacgttgaccaacaagaatagtagtagccatacctaaagacataggtaacataaatgcaaaggagctggtatttagtgcaatttgatggcttgctacaacttgagtaccgagaggtgataataatagtgaggtaagtgcaaataatgccacttcacaacataaagaaaccgcaataggcaatcctaaacgaaataattttgccaaagttttcatatcaggtttttcaaataaatgttcaaaaaccttgagatcacgttgatttctagcatgcttactatagacgatcatcattaagcacattatccagttgacaatagctgttgcaatgccacaaccaaccacaccaaacgccggaatacctaatttgccgtaaataaaaatatagtttagagggatattgcacagtaagccaaaaaatgtaatcaccatagccggttttgttttggcaatgccgtcatttaagcaacggaagttaattaataataaataaccaggtaatccccataacattgcacgtaaataactgatagtaatattggcaagtttttcttccattttcatatattgaatgacaaaatcgctattgtagattaataagccaagaggaatacagctaataaaaacaatccataagccttggcgtatttgatgagcaatatgatctcgttgtccggaaccatttaaataagagattgttggaggcaaggcaagtaataagccatgtccaaataatactaggggtaaccaaatagatgccccaactgcaacggcagccatatcagctgcactaacacgtccagccattattgtatctactaaccccatggaattttgtgctacttgtgcaagtaaaataggggtagcgatggcaattaattttttagcttctgtgtgatattgttgaaaacgagttaatttcataaaaatccgattttgctataatattggaaatatttatttagagagaactttatatgtttacaggaattgtccaaggaacagcacaaattcagtctattattgagaaagctaattttagaacacaggtaattaaaatgccacaggatttattagcaaatttagaaattggtgcatctattgcaaataatggtgtttgtttaacggttacagaaattaagggtgatttgattagcttcgacttaatggcggaaacattacgtattacaaatttaggtaatttagcggtaggcgattttgttaatgttgaacgtgcaatgaaaatgggggatgaaattggcgggcatattttatctggtcatgtttattgcactgcaacaatccaaaatcgtattcaagcagagaataatttgcaaatttggtttgaaatgcctacagctgaattaatgaaatatgtgttaactaaaggatttattgctattgatggaattagtttaaccgttggcgaagtcaaagggcagtgcttttgtgtgaatttaattcctgaaacaattaaccgcactttgattgcaaaatatgatataggtgatttagtcaatattgaaatagattctcaaacacaggcggttgtggacacagtagaacgctacttggcaaacagataaattcattttgcctaaaatctaaaattgtgggagtgtactctcacaattttatctatttatagcgtttttttgtgctttgctcatctaaattatgcaatcgtgctaatttttctttaagttgaatttccagtccacgatctgtaggaaaataaaatttcgtatcttttaattcttctggaaaataattttctcctgccgcataggcattaggttcatcatgagcataacgatattctgctccatatcccaactctttcattaaatgagttggtgcattacgcaaatgtaccggtacatcataatccggcatttcttttgcgagtttttttgcttgcttaaaggcaacatatacagcgttacttttaggtgcaacagctaaatatacaatcgcttgtgcgatagcacgttcgccttcagccgcaccgactcgggtaaaacaatcccatgcagcaagtgctacttgcattgctctgggatcagcattgcccacgtcttcagaggcaatggctaataaacgccttgcaacatagagaggatcgcccccagctgtgataattctcgcataccaatataaagcggcatctggtgcggagccacgaatagatttatgtagagcggaaattagatcataaaatcgatccccttgcttgtcgaagcgagcctgtcgttcccctaatacttcagttaggagacgatgattaatcaatttccctttttctgtttcatctgccatatccaccatgagttctaaacaatttagtgctaaacgggcatccccattgacatattcagctaaggtttcaagaacattttcagcgaaaatcaaccgctcttttcccaatccttgctctgcatcttggatagcattttgtaacactgtcacaatattagatgtagttaaaggtttcaaaatataaactttgacacgagagagtaacgcattatttaattcaaatgatggattttctgtggttgcacctataaaaatgatagtgccgttttcaatatgaggcaaaaaagcatcttgttgggttttattaaaacggtgaacttcatcaacaaataaaatagtttgttgacccattaaacgattttgttttgcccgttcaacactttcccgaatctctttcactccggcggtaactgcagaaatacgctcaactggagcatgaatttgttgtgcaataatctctgccagcgttgtttttcctgtaccaggcgggccccaaaaaatcatagaatgaatatgtccgttttcaatggctttatatagtggctttccagctccgattaaatgttcttggccacaatattgcttcagtgtttgcggtctcatttttgcggctaagggttgaaatgccgagtgagagaaatcaagtgaaaaagtggacatataaaactccattaaatgattaaaagtggacgtttattacgtccaatcatttcaattttaattaattattttttacgttgatcgtcaaattcaacgcccttaggcaaggtaaatgtgaatattgcatcatttaaggctggattggtaatcttacgcagaatatacaagttactttgcccatctttctctattgtactaaaattttttaatacaccatctttttcaattcgaatattaaattgcttgatggtacttttcttagatttgggtttaataataaacgtatcggatttttgctcaacaatatattgttgccaatgacttggattattacttgttagcaaaacaaagggggtatcgcttaaggtatcttcaacccaatttgctgttacttgctcaacaaaaggatcgtagaaccataatgtttttccatctgcaataatttgactttcttgaggtgtttcattgtccatacgaaataaattaggacgtttgagttgtatttttccactaccttgctgtattttttttccctgtgcatcagtcacttgttgtgtatagtcagcacttaacacatcaattttatttaaacgattttgtaactcattaaccgcatttgcccaagttacattactgatacctactaataaaagtgcggttaaatttagatattttttcattatttgtccttttcaattgagaatgaattgattcgatataatcaaaaggctgaaatgttgtataacatatcataaaagataagtataaaccctaaaaaataaataatattccgttcagtttatgatactgtgatctagtgcaaagaaaaatttttttcgctagctataatacaacttggtagtttaacagtttatttgaggagtatttcttatgcaaaattgggcacctgaggtatggcaaagtgcattaattggtttatgtattggagtttttatcggttacttattattgcgtttcactaaaggaacggtcaaaaaacagataaaaacagaggctgagttggagcaagtgaaaattcaacttaacaatcagaaacgacaattagagcaacattttgctgaaagtgcagagttgttaaaaaatattgcacaggattatcaaaaactttatttacatttagctaattcatctacaacactattgcctgaattggcacagaaagaattattttcaccgcatttattagccacggaatctatttcgtcacaacaagataaatcaaaagataatcagcctagagattattctgagggttcatcaggtattcttaaagctgaaaaataactatttctaaataggcacattgaggtgcctattttgctgtttttctttaatctctttgcatttctgaaacttttttgtattttttctgtcttaaattagcgatatgtatgatttaaatggagaaaaaagtgaaaaaatctagctttgttttaaccggtattgctttagggttaagtgttctaacaacatcaattaatgttcaagcaattttgcctatggcagttgatggacaatctcttccaagcttagcaccaatgttacaaaaagttttacccgcagtagtttctattgcggtagaagggaaacaaaaaaatgatttttctttcaataatgaaattcccgaagagtttcgccgtttttttggtgacagctttggttttgaaggatttagcagtcgtgcaccgcggagttttcgtggtattggatccggagtgattattgatgcagaaaaaggttatgtattgacaaataatcacgtgattgatcaggctgataaaatcacggtcaaattagaagatgggcgtgaatttaaggcaaaggttcttggcaaggatgatatgtcggatattgcacttattcaattagaaaatcctaaaaatctgaccgcagttaagatcgctgattctgataaattaagagtcggggattttacagttgctatcggtaatccattcggtttggggcaaaccgcaacatcgggaattgtttcggcattagggcgttcaacaggatttgatagcggagcttatgagaactatattcaaactgatgctgccgtaaatagaggtaattccggaggaccattagtaaatttaaatggtgagcttatagggattaatactgctattatttctccaagtggcggaaatgcgggaattgcatttgcgattccaagtaatatggcaatcagtttagttaagcaaattattgaatttggcgaagttcgtcgaggattactcggtattaaaggaggtgaattgaatgccaacttagcaaaagaattcaatattgatgtacaacaaggtgcgtttgtgagtgaagtattgccaaattcagcggcagaaaaagccggacttcaagcgggtgatgtgattacggcaattgatggacaaaaactggcaagttttgcggagttgcgtgcaaaaattgcaacaagtggtgccggtaaagaaattaaattgacctatttacgtgacggtaaatcgaaaactgcgaaagtgaaattgcaatctgatgatggagatacaatttctgcagttggcaacatttctatattagaaggtgcggaattaagtaattataatcaaaaaggcacaaaaggcgttgaaattaaagaagttaaatcaagatctcttgctgctcaatatggtttagaaaaaggcgatattattattggagtgaaccgccataaagtagaaaatttatctgatttacgtaaaattttaggcaaaaaaccttcagctattgccttgaatattttacgagatgacagtcgtttttatttattaatccaataattttactgaacctataattcttattaagacaaaacgaaatccgcactttaaagattgaccgatcaaagtgcggattttttgtgtttaaagatgatgttcttgtctaatttttttgagtaacgcatcgcagcatttatccagtaattgataagtctgctgaaaattgccggtataccaaggatctggaatatgatcacaagctaaatcttcacatatcgtggttatttgaaaaagtttagatggtgctttcgtaaagaatttttccaaatcatgtagattgttgttatccattgcgattaaataatcaaattgttgccaatcactattacgaatttttcggctggtaaaccctctgttatcaatagcatatttggtaagaatctttgccgtttcttggtgcatattttctccatcatgccaaccggaagttccggcactatctgtaaaaatttgattatctaaatgagctaatcgaattttttcacgcataatatattctgccattggggagcgacagatattacctaaacagacaaataaaattttaatttgtggtttcatgttaagcctttgccttatgatgaataaaagtgcggttgtaattgtacatgttttgtgccaatttagataagtttttattagcaataatctatggtaatattcgcttcccctttattttaaaagtgactaatcatgtctttaccaaaatatgttgaacaactgttaaaagagaaaagtaatgttcgggtattctcgtttaaatatgatgggaaatcttattggctaaaacaaaccgaaaaactttcttttatttggcggttcttgaaatccaatccagcggaaatgttaaaaagtgaaattattcgcttacaagaacttaataaaaaatcagcacctgtacctaagttagttttatttggtgataacttttttgtgactgaagatgtgggaagtagtgcaaatacttgggttgaaaatgaggatttatctattgaattaagaaataaggttttgtttgattgtgctcaagcattggcaagtttacataaacaaaatattactcatggtcgcccagccttgagagacatgatttggtgtgaagaaaaagttatttttgttgattttgaatgtacctcgtcaagtaataacatagattggcaaaaaattcgtgatggattagtttttattcatagcttaggacgttcttcaactgtttcggatgagcaaatagcattaactgttactcattatcgtcagtattgtgatgctgatatttggcagaaaactgctgattttatctataaatatcgttgggcatattatgttcttcgtattttcaaacctgttgcaagaatggatttaattgctatttatcgtttatttgaagctattttaaaaaatcaggaaacattatgataaaaaaaagtgattgtatggagtatttgtgcggtttggtaatggcagtttaagtgttaggggcatagtaatagtattcgattttttattaaattgtttataacatcaacaaataacaataaattagtaattttatcttgctattttttttatgacagatataatgtgacgcatatttcggacgcggggtggagcagcttggtagctcgtcgggctcataacccgaaggtcgttggttcaaatccagcccccgcaaccactttacatagaagttttcgtaaaggaccccactgtgacttggggtttttttatgcgagtaaacttgagatttagtaaacgggctgatagccctttttttacatctgtttgttatgaaatgtagaaaaaaactcaatcttacgtgttattttgagaggagaggatagtggcaacattagaggataaattacaagaattattacaaccttcagtagaggatttaggttgtgagctttggggtattgaatgccaacgttccggacgtttttttacagtacgtttatatattgataaaaaagatggcggtgtaacggttgatgattgtgctgatgtcagtcgtcaagtaagtgcggtgctggatgtggaagatcctattgcggataaatataatttggaagtgtcttcgccaggcttaaatcgaccattgtttacattaaaacaatttgagaattatatcggacaggatatttctgttcatttacgtgttcctatgtttgaccgtcgtaaatggcaaggtaagttagagaaaattgaaaatgatatgctgactttgattgttgataaccagccacaagtattagtttttggcaatattcaaaaagccaatgttgttcccaaattcaattaattagagagacaaaaatgagtaaagaaattttattagccgctgaagcggtttccaatgaaaaattgttacctcgtgagaaaatttttgaagcattggaaagtgcaattgcactttcgacgaagaaaaaatatgaacaagaaattgatgttcgtgtagtcatcaatactaaaaccggtgagttttctacgtttcgtcgttggttagtggttgaaacagtactcaatccaacgaaagagattacattagaagcagctcaatttgaagatccggaaataaaattaggtgactatattgaagatgaaattgattcgattgcttttgatcgcattgcgatgcaaacagcacgtcaagtaattagtaccaaaattcgtgaagcagagcgtaataaaattgtggaacagttccgttcacaggaaggtgaaattgtttccggtacagtgaaaaaagtaaatcgtgattctattattttagatttaagtcaacaggctgaagctgttattttgcgtgaagatatgttaccgcgtgaaaatttccgtccgggtgatagagttcgtggtgtactatacaaagtaagtccggaaaacaagggtattcaattgtttgtgactcgtgctaagcctgaaatgttagtggaattgttccgtattgaagttcctgaaatcggcgaagagttgattgaaattaaaggtgcctcacgtgatccaggattacgtgcaaaaattgctgtcaaaagcaatgataagcgaattgatccagttggagcttgtgtcggtatgcgtggctctcgagttcaagcaattaccaatgaattggggggggagcgtgtagatattgtgttatgggatgataatcctgcacaatttgtcattaatgcaatggcaccggcagatgtgagctcaattgttgttgatgaagataatcattctatggatattgccgttgaaccggaaaatttagcacaagctattggacgcaatggtcaaaatgtacgtttagcaacacagttaactggttgggtcttaaatgttatgacaatagatgatttaaatgctaaacaccaagcggaagataacaagattttagctttatttatgaccgcactagagattgatgaggagtttgctcatatccttgttgatgaaggattcactaatttggaagagattgcttatgttgctgtaaacgaattaacggcaattgatggcttagaagatgaggatcttgttgaggaattacaagctcgagcgaaaaatgcgattactgcaaggatgttagctgaagaagaagcattgaaacaagctcatgttgaagaaaaattattaaatttagaaggtatgtctcgtcatattgcatttagattatcagaaaaacaaattacaactcttgaagaattagctgaacaaggtgttgatgatttatcagatattgaagaattaagtgctgaacaagctgcagatttaattatggctgcacgtaatatttgttggttcaattaggaataaagagtaataagattatggcagatgaaataaaaaaagaaaatgcacccaaaaagttgagtattcaacgtcgaacaaaaactacagtgagtggaacaagtacaacgggaaaaagtaaagaggttcaggttgaggtgcgtaaaaagcgtacagttactaccgatcttgaacgtaaagctcaagaacaagccaaattaaaagccaaagaggaagcagagaaaagagctgccgaggaaaagcttgctgaaaaagcgaagcgagaagcggaaaaagctaaagctgagcaaataaagatagagaaagctaaggctgaacaagctaaagcaagtaagaaaaacgttgatgtagaaaaagaaaaacgtcgagcggaagaggctgagttacgtcgtaaagccgatgaattggctcgtcagaaggcagaagaaaaagcacaaaaagcggctgaagaagctaaacgttacgctgattttgatgagggtgacaatgataacggtaagttggatgattatagcgattatcacttaacttccagctatgcacttgaggcagaaaatgaagaagaacgtcgtaatgaaaatcgcggacgtagtaaaaataaagtagttaaagctaagaaaggtggacgagatgatgaaaatggtaataaaaatgaacgtcaatcagatcgccgtaaccaaaaagatgtaaaaggtaagggaaagcacgctaaaaaagccagtgcgttacagcaagcatttactaaacctgctcaagttgctaaagctgacgtagtgattggtgaaactattactgtggctgagcttgcagcaaaaatggcagttaaggcaacagaaattatcaaaaccatgatgaaaatgggagaaatggtaacgatcaatcaagtgatcgatcaagatactgcacagcttgtagctgaggaaatgggacacaaagttattctacgaaaagagaatgaacttgaagaaatggtcatggaggatcgtgatgtaaatgctgaaaaagttcatcgtgcaccggtggttactattatgggacacgttgaccatggtaaaacttcattacttgattatatccgcaaagcaaaagttgctgcaggtgaagcgggaggtattacccagcatattggtgcttatcatgttgaaactaatgatggcaaaatgatcacctttttggatacgccggggcatgctgcatttacttctatgcgtgctcgtggtgcgaaagcaacggacatagttgttttggtagttgcggcagatgatggtgtgatgcctcaaactattgaagcgatccaacatgctaaagccgccaatgcaccattggtggttgctgtaaacaaaattgataagccggaagcaaatcctgatcgagtagagcaagaattactgcaacacgaagtgatttcagagaaatttggtggagatgttcaatttgttccggtttctgcgaaaaaaggcttaggtattgatgatttattggaagcaattttgcttcaatcagaagtcttagaattaaccgccgttaaagatggcatggcaagcggtgttgtcattgaatcttatttggataaaggtcgtggtccggtagcaactattttagttcaatccggtacattaaaccgtggtgacattgtactgtgtggttttgaatatggtcgtgtgcgtgcaatgcgtgacgaaaatggtaaagatattcaatcggcaggtccatcaattcctgtagaagtactaggtctttcaggtgttccggcagcaggcgatgaagcaacagtcgtgcgtgatgagaaaaaagctcgtgaggttgctctttatcgtcaaggtaaattccgtgaagtgaaattagctcgtcagcaaaaagcgaaactggaaaacatgtttagcaatatggcagaaggtgatgttgcagagttgaatgttattgttaaagcggatgtacaaggttctgtggaagccattgttcaagcattacatgaattatcaacggcagaagtaaaagtaaaagttgtgggttccggagtgggaggaatcactgaaactgatgcaactcttgcagctgcttcaaatgcgattatggttggtttcaatgttcgtgctgatgcaacagctcgtcgtgtaattgaaaatgaaaatattgatttacgttattattcaataatttatgaattactaaatgaaatcaaagcggcaatgagtggtatgttacagccggaatttaaacaagaaattatcggcttggctgaggtgcgggatgtattccgtcatccgaaattcggtgcaattgccggttgtatggtaactgaagggctggttaaacgtaacaacccaatccgtgtattacgtgataacgtggtaatttttgaaggagaacttgaatctctccgtcgttttaaagatgatgtcagtgaagtacgtagtggtatggaatgtggcattggcgtaaaaaattacaatgatgttaaagtcggcgatcaaattgaagtctttgaagtagtggaagttaaaagagcgatttaatttgtaaccggtaatataattttgttggttgaattataactaaagagcgagattatcatatattaagttgcttaatgtttttgtggataagaatgcccttaactttgttttttaaggttaagggcattggagttttatcatgttttagaagagaaactgcgtatagtggtaaaaattaggaaaactcaccgctctttttaaggtgtaatttctcaactctagagtgaatttaccaacattaatggagaaaaatatggcaagagaatttaaacgtagcgatagagtagcacaagaaatacaaaaagaagtagcagttattttacaacgtgaggttaaagatcctcgtattggtatggtcacggtgtcggatgtggaaatatcaagtgatttagcgtatgcaaaaatatttgtcacttttttatttgatcaggatgaaaatgttattgagcaaggtatgaagggattggaaaaagccagtccctatattcgtagcttattgggcaaagtgatgcgtttgcgtattgtgcctgagttacgctttatttatgaccaatctttagttgatggtatgcgtatgtccaatcttgtgacgaatgttgtgcgtgaagatgaaaagcgtcatgtagaagaataagcgaataaaaatatgagtaaaccacgtaaaaaagggcgtgatattaacggtatttttttgttggataaatctcaagggatgagttccaatgatattatgcaaaaagttaaacgtcttttccaagcgaataaagcgggacataccggtgccttggatccgctggcaacaggaatgttgccaatttgtttaggtgaggcaacaaaattttcacaatatttacttgatgcggataaacgttatcaagttatcgctaaattaggcgagcgtacagatacttctgatgccgatgggcaagttgtgcaaaagcgagaggtcaatattgatttagcaaaaattttgaccgcacttgagcaatttcgtggtgaaattatgcaagtgcctactatgttttcagcattgaaatatcaaggcaaagctttgtatgaatatgctcgtgcaggcattaccattgagcgtgaagctcgtccaattagtatttttgaattgaagtttattgactatcaaataccttatttaacattggaagtacattgttctaaaggaacttatattagaaccttagtagatgatttaggtgaagtattgggttgtggtgctcatgttactaggttgcgtcggattgctgttgcagattatccttataacaagatgatgacgttagaacaattgcagcaattctctgaacaggaagatttggatttattggatcaacatttgttacctatggaaagtgcggttattcgtttacctggattgcacttaacaaaagaacaggcaagagctgtaggatttggacaacggattaagtttttaaatgaacaaggcatacaaggacaagtgcggttaatttctcctgaaaatttatttttgggtgttgctgttattgatgaaaacagcattgtccatcctcagagaatggttgttattaaacccgaataaatccaaccgcacttaagggcagatttattctgcccttgttttgtcaattaagctaattccgctcgtaattttttagtgaccgacatcatcacttcaagttgtgcaatggtctctgaccagccacgtgttttcaatccacaatctggattgacccataaacgctcttttggtacaacgttaagagctttgcgaagtaaatgttcaatttcttctgctgttggtacacgaggactatgaatatcatacacacccggtccaatatcgtttggatatttgaaatcaccgaaagcggttagtaattccatatcggaacgagaggtttcaatggtgatcacgtccgcatctaaagctgcaatagccggtaaaatatcgttaaattcagagtaacacatatgagtatggatttgtgtatcgtctgctacacccattgagcttaaacgaaacgcctctcctgcccattgtaaataagtatcccaatcggctcgtttgagtggcaatccttcacggatagcgggttcatcaatttggatgactttgattcctgctttttctaaatccaatacttcgtctgaaagtgccacaccaatttgcttacataccgttgaacgtggaatatcgttacgtacgaatgaccactgtagaattgttacaggaccagtgagcatacctttcatcactttcttggttagactttgtgcatattttgaccaacgtactgtcattggttcaggacgaacaacatcaccataaattacaggcggcttcacacaacgtgatccatagctttgtacccaaccaaatttagtgaaagcaaaaccgtctaataattcaccgaagtattctaccatgtcattacgttccggttcaccatggaccagcacatctaaatccaatttttcttgttcacgcacaacaagttcaatctcttttttcattgaattttcatactcttctaaagagagatcgcctttcttaaacgctgctcgagcacgacgaatttcggtagtttgtggaaacgaaccgatactggttgttggtaagagcggtagatttagccaagcattttgtaatttgatacgttcaccaaaaggtgatttacgttgatcggcattttttggcaaattagctaaacgttcagctacttccggacggtgaatttcttttgaatttgcacgagcatctgctgctacttggcttgcatctaattctacatttaccgcattacgacctttttcaagagcggtttttaagacgcttaactcttgtactttttgtaaggtgaaagctaaccagctataaagagcagggttgttctcttgtaattgggtttcaacatttaaatcaaatggtgtatggagtaaggaacagcttgtagcaatccataaacgctcacccagtttttcttttagtggctctaatacatcaagtacagtatttaagttagctcgccaaatattacgtccgtcaattacgccggcagacaataccttgttgtaatcttcgaatgctactagttgctccggagcacgaactaaatctaagtgtaacccatctactggtaattcttttaataaagtagcgtgttctgttactgaaccgaaataagtagctaataataatttcgcattcactttttcagatagcgttgcgtaaacgtctttgtacgcattaacccactcttttggtaaatctaccgctagtgcaggttcatcaatttggatccactcggtaccttctgccacgagtgcgtttaaaatctctacatacacaggaacaagttgagcgagtaattcaaaacggttaaaggattcgcctttctctttccctaaccataaaaatgttaaaggcccaacaattacaggtttaacttggtgtcctgcaactttcgcttcacgaatttggtttacataatgtgttgggtttgctttgaattgtgtgtctttatgaaactccggtactaaatagtggtagttggtatcaaaccatttggtcatttcaatagcaaattggtctttgttacctcgtgctaattgaaagtactgatcaagtgtcaaatttttactatcgaaaccgaaacgagcaggaatagctcctgttgcgacttgaagatctaaaatatgatcataaaaggtaaaatcacctactgccacaaaatccgcattggcatcagcttggtggttccaatttttttcacgtaatgccttagctaaatctaatagatcttgctcagccaactctttacgccagtaacgctcttgagcgaattttaattctctttttgctccaacacgtggaaaacctaaaacgtggaatgttgtcataactaaatctcctgtatggtaagtacaattttgaatagacgtctaaacgtctgtgttttggtataatgcaataaaagtctttaatgatgcaatctcataattttcacgttttgtatgaaaaaaattaataaaagagcggtgtaatttaggtaagattaatagaaaaaagtaatgagcatgaagaggttgttattgaggcgtttttttatgggcttggtttagcctcttcaacaggtgcagatagaacatcccaaatagatggctttggctcttcgggaatgtcattacaaaaaaactgatcgttatttatccaaactggaagctttttaggacttgagcaattccagtttccataagagtctataccaatccattcaattttagctggtgtttgtggatttaacatttttatttcagcacgagataaataatcttgatagatttttaatgcaccactcgcaccggttaattttgttgttacattatcatctcgccctaaccatacagtaacaacattctcaccatcaataccaacataccaagtatctcttgattcatttgttgtacctgtttttccggcaagtttaagtgaagcgtattgattttgtaagctacgagctgtccctcgttcaacgacttgttgcatagcaaataaggtttggaaagctgcttcttggggaacgacttgttgtggcattattgaacgttggtaaatcagattcccctgcttgtctgtaatactgtcaagagttgacaacggaatatgttttccttcattggcaatagtttggaataattctgtaacctcataaggggaaatagagtaactacctaacaaagttgaaggcacgttaggtatttttacattatcccaacccattgccatttgcatttcaattactttgtttaagcctactttcataccaatattaactgttggaatattgagcgagcgaacaagtgcatctattagcatgacggaaccactgtattttctatcgtagttacgaggctgccatggctgagttcctttgatacgaattgtaataggctgattttgaataagcgtattaaggcgaaattgctcaggatcagataacgccactaagtaaattgacggtttaactaaggaaccaatttggcgacgagcgtgtaaagcacggttaaatcccgcatagtttgtctgtaaaccaccaacaatggcttttacttcacccattttataatcagcaataatcatcgcactttctaaatgtggatttttatattttcgctgtaattctgagactgcttttatcacggatttttctgcatgttcttgttgtttcggatccaaagtagagaaaattcttgcaccggataaagaggaaagtttgttttcgcccagtttgcttcttaattcttgctgtagagtttgaataaatgccggatacttgcggttaatttgtcctcttttttgtacgctgagaggacgtttactgagtaagtcatagagttcattactaatcattttatgactgagcattaattttaatacaacattacgacgttctaaggccttttgagggttacgccaaggattgtatagtgaaggaccttttaccatgccaaccaacaaggcaatctgatccaaactgatttcccgaacaggtagcccaaaataaaaatggcttgccaattcaaatccatgaatttgtgtgttgccattttgtcccaaataaatttcattaagataggtttctaatatgcgatttttatcgtaacgaaaatctaaaatcaaagccattaatgcttcattcattttacggcttaatgtgcgttcgttgcttaaaaataaatttttaaccagttgttgtgtcagtgtacttccgccttgtacattatgtcctgctttgatgttggtaattaaagcacgaataatgccaagtaaacttattccatcatgttcataaaaatggcgatcttcggttaaaagtaaagtatcgatcaataatcttggataatgttgtagcggaatagctagacgttcttctctatctgattgcaacatcgcaataagttttggatcaagacgaaactcactgatggtttttacattgatcaggtcttcaatgatagaaagtttattatcattattaaaacgtaggcgaaaaaggcgttgtgcttcaggttgacttgggaaagggaaggctctgcgtaaaataaccaaagtgttattttcaattttaaaatcacctggcgtggcaagcatggtcgtttggcgatattcattttctaacagtgcttgtttgatttgttccagattcagttgatcagataaacgtatgttttcaatacgactataaacctcggcgggtaactgccaaatttgaccatccattttattgcggatttttccgtctaaataaataccataaaatgcaattccacataatagagtaaaaccaagttttgcactaaaaataaacaaccgttgttttttatttttctttttgggttgagttgtatttcgtttttgtttcgcagccatttttatttagtttaagcaataaaagagagataggattttagaaaatattcaaaatcttctaagccacaaaaagcaatactttcttcatcataataatggaaatcagcttccagttcatcgtgttcttcaattgctaaattattggctttaatcataacttcatctgaatgaataaaaacagaaaattcgtttccaatgagactaaactccttttcattgcgtgattgttttgcttgttgcagataattaagtgcggtaggaatcaagtcagaatttaaccgcacctctatattgaaccaattagctattgcctcatgttccatagaaaaattaactgttacttgatcagcgttgtgagtaaattgatagtccattgtttagatactaaaagatgagccgcaaccgcaagttgttgtcgcatttgggttattaacaataaatcttgagccttctaaaccttcggtatagtccacagtaccgccgattaggtattgtaaactcattggatctacaactaatttaacgcctgcattttcaatgattaaatcaccgtcattagttttttcatcgaaagtaaagccatattggaaaccgctacatcctccaccggtaatataaactcgtaattttaattctgtattttcttcttctgaaattaaggttttgactttatttgccgctgcatcagtaaatgtcaaaggaactgcaatatctgccatagtattttccgataataaaaattagtgggctattatctaataaccaaccaaaccattcaagatttataaaaaatttaatgttataatgcacgacaaattttatgtctagagaagatattatggcgattccattaagaacagaacaagaaataataaagttacgtacagcttgtaaattggcatctgacgtgttggttatgattgaaccttatgttaaggcaggtataacaaccggtgagttagatcgtatttgtcacgaatatattgtgaatgagcaaaaggcaattcctgcttgtttaggctattatggctttccgaaagcaacttgtatttcattaaatgaggttgtttgtcatggcattccgactgaaggcaaagtgttaaaaaatggtgatattgtaaacattgatgttacggtgattaaagacggctactacggcgataactcaaaaatgtatattgtcggtgaaaccaatatccgcagtaaaaaattagttgaggcggcacaagaggcattatatgttggtttacgagtggtgaagccggggattcgtttaaatgaaattggtagagcagtgcaaaaatataccgagagtcaaggcttcagtgtagtgcgtgagtattgtggacatggcattggtaccgaatttcattgtgatcctcaagtgttacattattatgctgatgatggtggtgttattttacgggagggtatggtttttactattgaacctatgattaatgcgggcaaaaaagaagtgcgtttaatgggcgacggttggacagtaaaaaccaaagatcgtagccattctgctcaatatgagcatcaacttgttgtaacgaaagatggttgtgaagtgatgacgattcgtgaggaagaagaaaaagtcggacgaattagtagaataatggttaatatatagtatcaattcaacgtgcaatcttttcaaggttgcatttcttttatttcaggacatgctatgttttcttatcttccaattccaaatccaacgatagcaacaataaaagcacaaaaagaacagcttaaacagtttgagttgacatattttcagcgattttctgttgatcaactcattcgtaatcgttcagtattttgtgatcagttattaattcacctatggcaaatttttcagcttgagaaaaatcacttaacccttgttgcagtaggcggttatggacgggaagaactttttcctttatcggatcttgatgttttgttgttagttgaagatgaacctactatcgagctggaggaaaaaattgcacatttttttcggtttctatgggattgtggatttgaggttgggcattcagtacgcactttagcccaatgtgaacaaagtggacgagaagacatcaccattgcgaccaacttattagaaagccgatatttatgtgggcaacaagatttattcgaaaaattaaccgcacttttgcaacaaaaaaatttttggcgaaatgaggatttttttaatgctaaagttgcagaaaaagttacacgctatcagcgttaccataataccggttataaccttgaacctgatttaaagtatagtccaggaggattgcgtgatttacatcttatttattggttggctttaaagcatataggtgctaaaaatttagaagatattttgcacgctggttttatttatccacaagaatattctttattaaagcaaagtcagcaatttttatttcaagtgcggtttgctttacatttaattttaaaacgttatgacaatcgcctgttatttgatcgtcagcttaaagtttgtgaattattaggttttgttggtgagggcaatcaaaaggttgagaaaatgatgaaagtcttttttcaagcttcacaatctatttctgtattaagtgatattttggttaaacattaccaagagcattttttagccggttcacaaattattgagcaacaagttttagattccgatttttatcttattaataatgcaatttgtgtaaaaaatcctgatatatttattcaaatgccggataaaatattgatgctattttactatttgacacaacactctcatgttgaaattcattctgcaacattacgcaagttgtatattgttactcaacaatttactgggaatttatctgattttcctcttgcaagagaacgttttttacgtttattttcacaacctaattctatttctcgtgctttgttaccgatgcataaatacggtgtattgaacatttatttaccacaatggaaagggattaacggattgatgcagtttgatttatttcattcttatactgttgatgaacatactttgcgagtgatgttaaaattagaagagtttttagcggaagaggcgaaaaaaaattatccgatctgccacaccattttctcatcattaactgaccgcactttattatatcttgccgctttatttcatgatattgcaaaaggcagaggaggggatcatgctgaattaggtgcagttgatatgcgtatttttgcacaacaacatggctttgatagtcgagaaagtgaaactatggcatggcttgtacagcgacatttgcttatgtctgttactgcacagcgtcgagatattcatgatcctgaggttattctcaattttgctgaagaagtacaaaataaagtgcggttagattatttaacttgtttgactgtggctgatatttgtgcaacgaatgaaactttatggaatacttggaaaagatccttatttacgactttataccaatacagcctagatcagtttcaacaaggaatagatattttattaaatcatcaagaaaaagctgaagaaaaccgcaaacaagcgtgtattttattacaacaaaagtatggatttttatctgaagctcaaattgagcatcactggcaagattttccttgtgagtatttttggcgtaatagcccgaagcaaattgcttggcattctgagttgttacttgataataatcaagatttattgattaaagtcagtaatcgtttttcttatgcagggacagaaatttttatttattgccaagatcaagcgaatttattttataaagttgccagcattattggagcaaagaaattgagtattcatggagcacaaattatcacaggaaaaaatggctatgtattcgatagtttgattgttaccgagttggatgggggcttgctgaacaatgatcgtcgccgtcaattggaaggtgcattaattaaaggattaaaaacaaacaagattgttaacccagttcgtataaataaccataaattacaacatttccatgttaaaacagaagtcagatttttaaatgttcataagcaagaacaaactgaaatggagctttgtgctttagatagagcaggtttattagcagaaattagtcaaatatttgtacaattggagttgaacttattaaatgcaaaaatttctacaattggtgaaaaagtagaggattttttcattttaaccaataagaaaaatgtagctttaacggaacaagaaaggttacgtttacaagatcgtattgaaagtaattttagctaaagataaatgtctacattgcatagattttttatgctaaaatccgcaaccgatttattttattgctgaataggaaaaagaatgaaggttttagaaggtatagttacagcacctaatgccaaaattgctgttgttattgcacggtttaatagttttattaatgaaagtttattagagggagcattggacgctctaaaacgtattggtcaagttaaagatgaaaatattactttcgttcgtgtaccaggagcttatgaattgcctttaattgctcgtcgtttagccgatagtaaaaaatatgatgccattgtggcgttgggtactgttattcgtggcggtacagcacattttgaatatgtagcaggggaagcaagtagtggtttagggcaggttgcaatgcaggcggaaattccggttgcctttggtgtattaactacagaaaatattgaacaagcaattgagcgcgcgggaactaaagctggtaataagggggcggaagctgcacttgttgcattagaaatggtgaatttgttagctcaaattgacaaggcatagtagataaaatgacagaaaaagtaaaaaaaatatccccacgtcgtcgagcaagagaatgtgcggtacaaaacctttattcttgggctatttcaaaaaattcacctgaagaaatagaattaaacttcattgtggatcaagataatgagatgaaaggcgtggatatgccgtatttcagaaagttgtttcatcaaacaattaaccatgttgaaactattgatagtacaatggcaccttacttagatcgtgataatgttgagttagatcctattgaatgtgcaattctacgtttagctgtttatgaattgaaatttgaattggatgtaccttataaggtggtgatcaatgaagctattgaggttgctaaagtatttggtgcagaagaaagccataaatatattaatggtgttttagataaaattgcacctgcactttctcgtaaatagataggtttatcataatgagcaatggcgaatttgatattattcaacgctatttcatcggatcaaaacgtccacaacgtaaagatgtgattgtttctatcggtgatgattgtgctattactgaacattatcaaaatcagcgaattgctattacgactgatacgatggtagaaaatgtccattttctgtcttctattaatccttcggatttagcatataaagctgttgcaacaaatttaagcgatcttgctgcaatgggggcgactcccgcatggttttctcttgcaatcactttaccttatgttgatgaaaaatggctcaatgaatttagtcaaagtttatttgatgtattggatcattataatgtgtcgcttattggtggagatacagcaaaaggtcccgtatatacaataactattactgcacaaggcatcgtacctaaagggaaagcactttgtcgccacagtgcacaagatggtgactggatctatgtttccggcacattaggagacagtgcggcaggattggaattactattaaaaaatacagaggaaacgcatagtaaaagtcatcaaagtgcggttgattctgcacaagaatatttaattcaacgccatttacgtccaacccccagagttttgcttggtctggaactagctagtgctgagttggcaaatgctgcgattgatatttctgatggatttattgcagatttaggacatattttacagcgtagtcaatgcggtgcagtgatcgatttagataaattacctttatctgagcaattaatcaaaactgttggtatagagcgagcggagcgatttgctttaactggcggagaagattatgagttgtgctttacagttcctgatcgcaatcttgaaaagttagagcgagctttaacccatattggtgtgaattatagctgtgttggacaaattcgtaataaaaaacgtatcagttttcaacgcagcggtaaaactgttgagattggttcattactcggctttgatcattttaaataagatttcattatgacaaataatcctttatctcgtatttctttaaccaatcctattcatttttttgcacttggcttaggttcagggcttattcatcctgctcccggcacttggggtacccttgccggattaattgttggttgtttgctattacagataatgtcggtgttttcttttgcaattttcactgcactttgttttttattaggatgttatttgtgtcaacaaacagcggatgatatgggcgtacatgatcatggctcaattgtgtgggatgagttcgtcggtatttttaccgtgttactcgctattcctgaattatcattgatatggtgtagtattgctttcgttgtattccgtatttttgatattttaaagccttatcctattcattattttgatcatagattagaaagtggcttcggtattatgttagatgatgttttagctgctatttatacggtcataagtatttctatcttaaattatctcgtgtagaggcgattgattatgctgaatttattattggttaacttatttgggttacttaccccgggacctgattttttttacataagtcgtttagcagctagtcattctaagagaaatgccatttgtgctgcgtttggtattagcttgggttgtttagtttggtcaacttcagcaattcttggactggctgttttattgacaacttacccaagtttgcaaggcattattatgatgctaggtggcggatatttggcttaccttggtgtattaatggtgaaaagtcataacaatattgtctttgataatcgtgaacaagcagaaaatttaagaaacagtatgggtaaagaaatcttaaaaggattattgattaatttatctaatgcaaaggctattatcttctttagtagcgtgatgtcttttgtattggttgatttaactgaaacatggcagattattaccgcacttattttattaactcttgaagtatttttgtatttttcttttattgcacttattttttctcgtaaaaccgtaaaaaaattttatagccaatatagccattatattgataactttgcagggatcttttttctttgttttggcggttatttaatttatagtggtcttttcttaggatttggcaattgataaatagagagggataaaatgacgttaaaaattggtattgttggttcgggtggtcgtatggggcgtcaactgatacaggcagtatatcatactgaaggcgtagaacttggtgcggcatttgagcgtgtcggttcatctttagttggaactgatgcgggagaactggctggaataggtaggattggtattaaagtaaccgataatttaactcaagaaaaaggtaactttgacatcttaattgattttactcgaccggaaggtaccattcagcatttagcattttgtgtagagcaacataaaaatatagttatcggtacaacagggtttgatgatcaatccaaacaagctattcaacaagcagcacagaatattgcaattgtttttgcctctaattatagtgtgggcgttaatttagtttttaagctgttagagaaagcggctaaggtcatgggcgattattgcgatattgagattattgaagctcatcatcgtcataaagtagatgcaccttccggtactgcactatctatgggggaacatattgccaaaacgttaggcagagatttaaaaacgcatggcgtgttttctcgggaaggtattacaggtgaacgtaagccggatgaaattggattctcaacaattcgtgcggcggatgttgttggtgagcatacagtatggtttgcggatatcggtgaacgagtagaaatatctcataaagcctccagtcgaatgacttttgctaatggtgctgtaagagctgcaaaatggctttctactaagcaagaggggctttttgatatgacagatgtactggatttaaataatctgtaagtgcggttagatttggttcttgaaaattgcacatctttgatctttcagtattcgtcatttaagatgttgctaagatgttgatggaataaaatcaatgccaaaattttagccagtccgaaaaatgggtataatgcccactgatattatatattttaggaatagtagtatgaaatttatttcatttaatattaatgggttaagagcaagacctcatcaacttgacaggattgtagagaaatatcagcctgatgttattgggttacaggaaattaaagtgtctgatgaagactttccctatcatcttgttgaacatttaggctaccatatttatcatcatgggcaaaaagggcattatggtgttgctttgttattgaaacaagaacctaaagtaattcgtagaggcttttctactgacgatgaaaatgcacaaaagcgtataattatggcggatttagaaacagattttgggttgctaacagtaattaatggttattttccgcaaggtgaaaaccgtcagcatgaaacaaagttcccagccaaagaaaaattttatacggatctgcaacattatgtagagcaagagcataacagaaataatccaattttaattatgggagatatgaatatcagcccgacagatttagatattggtattggtgaagaaaatcgaaaacgttggttgcgtacaggaaaatgctcatttttaccggaagaaagagaatggataaatcgtctatataattatgggctgattgatacatttcgtcataaaaatccgacaatcaatgatcaattttcatggtttgattaccgctcaaaaggctttgatgataatagagggttacgaattgatcatattttagtgaatcaattattattagaacgttgcgttgatgccggtatagcttttgatattagagcgatggaaaaaccatctgatcatgctccgatttgggcggaatttaagtgaggaacatagaatgggaattgaacaagaatggcaaaattatcgatctaaaattaatgataaattagccgtattttcagttaatttaaaacttcttgaacaatttccagtcgtaaatcatatatgtgaaattgttgtccattttgaagtcccttatatttcagatgcacaaggcttaccgcaaatagaaagttacaccggtttgcaacaagatttgctcaaaatatccagtttaatttctgcccaacctaatgtttattacgcaggcaatattctttgtaatggcaatgctacattgtatttctattgtaacgatgctttagatattacagatgtattatctgataattttccaaacgctgtaaatattgagaaacaattcgattcaacgtgggatctatattttgattttttgatggcatctcaggcagatttgaaagtaaatgcagcagaagaattattggcaactttaattgaaaaaggagaagatatctcgaaaagttatcaaattgagcatactttttacttttacaaagaaaatgatctttacttatttttggagaatattgctacttctgacatatcatttttatcgctaaaacattcttctaagcaaataaatatgaatggatataatgtatatattgctaaaatagagcaagaattgtatttaaatgatgccagtatttatcaatatataagaaattttgaagaactcgctttgcaacattcaggtgaatatattggttgggagagcgaagatattggtataaataaaaatcaactaaattaatttttaaatttaaaaaaccttacaacagaataagatgtaaggtttttaatcggattaaagcaccttgacaatactttcacataaataacgaatattatcttcagttacaccggctaaattaatgcgtcctgaacgtacagcataaatggcaaattcttcttttaagcgatccacctgttctgcatttagaccactaaaagagaacataccattttgttcaataatgaagctaaagtcttgcttggcaccatattcttttagcaattcaacgaattgataacgcatacgtttaatgcgattacgcatttcggttaattcggattcccattgttgacgcaataggttatcacctaaaataatagaaacagccgtagcaccatgagaagctgggttagagtagagagtacgaataattgatttcacttgtgttaatgctattgctgaaatttcttctgtttctgctactaaagtaaaggcaccaacacgttcattgtataaaccaaagtttttggaataagaacttgcgactaataattctttatgattttctgcaaaagttcgcaaaccaatagcatcttcttctaacccgttagcaagaccttgataggcaaaatcaaagagcggtaaccaaccatttttttctgacatttctgctagtattttccattgctcaggggttggatcaatacccgttgggttatgacaacaaccatgtaataacaccacatcaccctcactggcattgcttaagtcagcaattaaattatcccaatctaaagcttttttctccgcatcgtagtaacgatattcacggattgtcatacctacagcgttgaaaatagcattatggtttggccaagttggtgaactaatccaaacgttttgagatgtggtttgacgtttgataaattcggcagcaatacgtaacgcaccggttcctcctaaactttgtactgttttagcacgtccttgtttaataattttagaatttgtaccaaataataattctttagtgtatgaattaaactctgcaataccatcaatagttaaatagtttttagtggtttctaattcaaatagacgattttcagcttctttaacagctttcataatgggggtgttaccattagcatctttatagaccccaatacccaagttaattttattggcacgtgtttcagatttaaaagcctcacctaaacctaaaattggatcagcgggtgcagcattaatattctcgaacatagtagtatcctcaataaatagttgtgtttgaatagatttctttatactggtaaaaacttatctttgcaaccctttagctaagttaaatttaattatttaattttaactttataaaatatattaaaaattatttgctagattaaattatttcaatttttccaatgcccaatctaaaccaaattgataatcttgcggtagtatgtagcgtaatttttgtaaattatctattaaaatagatggagttggatgagataaattaagatgcccaactttacgaccttctcgtacttcttttccataccaatgtaattgtgaaaatggcaaatttaaccattgtggattatgttcagtgccaattaaattcaccataaccgacggcatagctacttgtaaatcaggcgtaggtaaatctaataacgcacgaagatgtaattcaaattggctaatcgaacaacctaattgcgtccaatgtccgctattatgtactcttggtgccaattcattgactaataattgatcttgcacaacaaaacattccattgccattacgccaacataatctaatttatccataattttagccaacattatttcggcttgtttttgttgttgtgactgttgtggaaaatttaaattcatgacactgtaacgtaaaataccattctgttgcagattatgcgtaacaggataaaaacgagttttgccatttttaaaccttgcaccaaccaaagaaatttcataatcaaaaggaataaatttttcggcaataacttcgccaaaaagctcattgccgattacatcttgattgtttttatctacaatccattgtcctcgtccgtcgtaacctcccatgcgacgttttacaacaactttttcaccaatttctgtaaaaatagtgaaaaaatcctccgcactttgtaccaacctccaaggggaagtaggaatatttagtgcgttaagcaaggttttttgtgtaaaacgatctgctgtagtggcaaaaattttttgattaataaatttatcgtgattagccaacatttctgtaaggggtgttttttcccaacgctcaatttctgctgtaataatactgtcagcaggcaaatcaaaaacaggtgcatcaaaagcaagaggttggacattaatatctaaaggtgcacccgcataacgcaacattctgcccaattgcccattacctaaaacatacactgtaggatataaagtgcggtttaccattaaatgatccttatacttaattaagatattgtaaatttttatttactctgattttacttgatgaggttttagtagtaactcatcttcgttcaatttaaataattttgctattgtatcacgatatgatatttctaaagtttctcggctggttgccgttacaccttgatcaattaaaaaaccgtcgttaacatcataaatccagccatgcaaagaaagtttttttccacttttccaagctgatttaacaatagatgagctgcctaagttatacacttgttccgcaacattaattcttgtcaacatatcagcgcgtttttcgggagataacttacccaataaatgaccatgtttaaaccaaatatcacgaatatgtaacaaccagttattaatcaatcccagatcttgatccaccatagcggctttaataccaccgcagttggtatgcccacaaataataatatgctcaatatttagcacatcaacagcatattgcaccacagataaacaatttaaatcagtatgaataacttgatttgctacatttctgtgcacaaacaattcaccgggctttaaatttgtcaaattttccgcaggaacacgactatcggaacaaccaatccataaatagctaggtgtttgattttctgctaacgctttaaaatactcagcattttcttctttcatcctatttgcccaactaaaattattggcaaataactgttcaatttttttcatttttttaccgctcctaaagatgcacagtatagcctagaatagaaaaacggtaaaataaaaagccctgtaagataacagggcggcgaaatttaggtaggattgaatatcatcacaacaatgtcgcttgtttcattttttgcacgaattctgccaattcggagaggcatttttcttgatctgtgagatttcgttcaataatttgcactatagctgaacctgaaattgcaccggcaacgcctgattttaacgcatctttaacttgttgtggttgagctatgccaaaaccttgtaaaatcggagctgagccatatttttttaagcctttgatgagattagctagatttttcgcactttgttgattttcagcacttgttacgccagatcgagaaactaaataaatgtagcctttgcttttttccgccactgctttaagggttgtttcatctgcattgggtggacagataaaaaccggttgaatgtcatatttttgagcggattgaatatacggttcagaagcaagcagaggaatatcagccaccaataccgcatcaactccgacttcagcacagcgttgataaaatccatctaaagtttgagcataaattaagttggcacaaaggagtagactgatcggaatatcgggatatttggaccgcactttggcaattagttgaaaactttcttttgtactgcagcctgcgtttaaagcacgatgattagcagcttgaataaccgaaccgtcaagtaaaggatcggagaaaggaaacccaagttctaaagcatctgcaccgttatccactaaggtacaaataatttcaaaagagcggtcgaaatttggatcgcataaagtaacaaaaggaacaaaagcaccttgtttttgcttttgtagttgtaaaaatttttgttcaaaatatcccatcagataattcctttctcggttaaaattttatctacagtaaaaatatctttatcgcctcgacctgataaatttactacaagtaattgttctttttccggattttgtacaatgagttttaaagcataagccaaagcatgtgagctttctaaagcaggaataataccttcatgtttggctagggcttgaaatgcctcaattgcttcatcgtcagtaatactttcatattgagctcgcccaatagtatgtaaataggcgtgttcaggaccaacggatggaaagtctaagccggcggaaatagaataagattcctcaatttgtccgtcttgagtttgcataatcggggatttcataccaaagtaaatgccaatggagccatgacgaagtggtgctccatgctttcctgtatgaataccgttgccggcaggttcaattccaataagttgtactgatttttctgcaataaactcagcaaacataccaattgcgtttgaacctccacctactgcggcaataacagcatcaggtaagcgattttccttagctaaaatttgacgtttagtctcttcaccaatcattttttgaaattctcgcacaatagtcgggaatgggtgcggtcctgctgctgtacctaataaataatgggttgtctcataattagctgaccaatcacgcatagcctcacaacaagcatcttttaatgagcaagaacctttttcaacaggaataacttcggcacccattaaacgcatacgaaatacattcggcgattgacgttcaacatcttttgctcccatgtaaactcggcaaggcatatccaacatggcacaagctaaagctgtggctacaccgtgttgccccgcaccggtttccgcaataatacgtgtttttcccatacgttttgctagcaaaatttgccctaatacttgattggttttatgtgccccgccgtgaagtaaatcttcacgttttaaatacaattttgtttttgtacctttagtgaggttgcgacataaagttaacgctgttggacgacccgcataatttttaagcaaatcttgaaattcttgctgaaacacaggatcgtgctgtgcttcaacaaaagccttttctaattgttttagtaccggtaccagaatttccggtacatacattccaccaaattcgccaaaatagggatttaaaattgtacccgtcatattttttccttattgattttggattttgtcaaaaactgtttgtaattttatttgatcttttatgccgttggcacattcaacacctgaatttaaatcaatccctagacaatgttgttgcaatgcttgttcaatattttgaatatttattccaccggcaagcatgactttgtatttaatggagggaggaatataattccagttaaaagtttgtcctgtaccaccttgtcgattatctgccttactatcaaaaacataacgatctacataaggaatttcttcaaaatctaccgcacttttcccttgttcatattgctcggtaacgtcaatcgtaacagctttccaaatttgacattgtgtaggtagaacttggcgaagtgcggtaataaattcagcattttcatcaccatgtaactgcacggcgaacaattgtaattgtgtagcgatgttatggataaacgcaatagactgattttggaaaacgccaacaaaaagcaaaggtgcttgcttaaccaatttctgtgcttgacatagggagagtttacgaggagaactttcagcaaaaatcaatccgccgtataaagcaccttgagcatagcttgctttgacatcttgtccacgtgttaaaccacaaactttgtgttcacccaaaagtaccgaacgtacggcattgttaagatctttaccactagttaaactgctaccgattaaaaagccatgtacataaggttttaattgttgtacttgttgatgagaagaaatacctgactcgctgatcacaatgcgatctgccggaatttgtcttgccaaaggaggcgtgcggttaagatctacggagagatcgtgtaaatttcgattattaattccaattacttttgcacccagttttatggctcgttctaattccttttggttggatgtctcagttaaaacacccattccaaggttatgtgcaagatcagataaagtgcggtaagtttcatcatcaagtatcgacaacatcaataaaattccatcagcttgataataacgtgctaaatacacttgatatttactcagtataaaatctttgcaaagaataggttgagtagcctgcttacgtactaaaggcaagtagttaaaatcgccttggaagtatttttcatccgttaaaacagaaattaccgaagcataatttttatagacatttgcaatttctactatattaaaattagaacgaattaaacctttcgaaggtgatgcttttttgcactctaaaatgaaagcggggcgttgatgtgtaccttggcttaacgcttgataaaaagagcggtcggatttttttattttctgttgaaattgtgcgagaggaaacgacgattgtttttctgcgatccattgttttttatcttgtacaattttttgcaaaatagaagggatattgtgttgcatgataattcctatttattgatacgtttttaattggtttaatgtttcaaatgcttcaccgttcgccataatatttaaggctttttctgcattggctttaagatcatcattgccaaataatttcattaataaggcaacattcatagcaacagcttgattatgctcatctttgccttttccttgtaaaagtgcggtcaatatttcggcattttcttctgccgtaccgccacgtaaggtttctaatggtttaggactaaagccaaagtcatgaggcgttaaactataatattcaatttttccatgacgaatttccgcaacatcggtttttccatgaatagcaacttcatctaaaccggaaccatgaataacgatactatgttgatgctctagtcttaatgcactctcagcataggttttaagtaagtgcggtgtataaacccccagtagttgatgttttggacgagcgggattgcataaaggacctaaaatattgaaaatcgtgcgtgtttttaatatttgtcgtacaggtgcgacatgtttaaatcctgaatgatattgttgagcccaaagaaaacaaaggttgagattatctagagcttgtttggacttttcggcagataagtcaatttttacccctaaagcattcaatacatcacttgcaccgcttttaccggatacacttcgatttccatgttttgccactttgtatcctaatgttgcagcaacaattgccgcagtagttgaaatattgatggtattagcattatcacctcccgttccgacaatatcggcaaaagggtagtctatgaatggaaatggcttagcgttggcaataatggcttttactgcaccgctaatttcatctgcttgttcaccacgaaattttaaagcgataagtactcctgcaagttgttcattagaaagttgtccttgaataatataatgaaataactgttgtatttgttcttggtttaaatgttgtccgtcgaaaagttgactgattaattgttctgtttgcatgttgttttccttcttatttttcgttctatgttgacgtcggtaaatcataaataattatattgttctctactttgagccaataaccattgaatactttgctctaataactgtgagccttgcttcgttaatatactttcagggtgaaattgaaaactgcaaataggcaaggttttatggcggatagccataatgattcccttatattcagcattaataataaactcttccgaaatttttcttcccattaaagaatgataacgagcaactggcataggattatctaacccctgaaacatcatttggttatcatgataaatatttgatactttcccatgtgaaatttcaccggagggaacaacttctccaccgaatgcttcaatcaaagcctgatgccctaaacaaatgccaatcatagctactttaccttttagtgtttgaattaaaggcaataaaattcccgcctgtgcaggagtacctggccctggtgagagggctaaaacagtctctttttctgctaaaataatttgagttaataactttaaatcgaagttattgcaaaaaacttgtacttgatgccctaaactgcggaattgatctactagattgtaagtaaaggaatcaaagttatctaaaaatataattcttgccatattgtctccttagtcttgagtattggtttgcaatattgcattaatcacagctttagctttgtgacgggtttcatcagcctccatttgcggatcggaatctaagacttcaccacaacctgcttgaatataagcaataccttgttgtacaaaagcggaacgtatcacaatacaggtatcaaaattaccatcagaagataaatatcctattgcaccgccataactatgacgcttttgtttttcaacttggtaaattaattgcattgctttaattttcggggcaccagttaaagtccccatattcatacaagcctgataagcatgaaaggcatcaagctcggggcgtaattttccgactacacgagaaacaaggtgcataatatgagaatagcgatctacttgcattagctccttaacctgtcttgtaccgctttcacagactcgagcaatatcgttacgagcaagatcaacgagcataagatgttctgcgagttctttcttgtctaaacgcaattccaactccaaacgagtatctaattcaggatcgatattaccctgttgatcaaagccacgagaacgagatccagcaatcggataaatttctacttggcgattttcagcattatatttcaatgcactttcaggagaggaaccaaataagatgaaatcggtatcttgcataaaaaacatataaggacttgggttatttttctttaattgacggtagctggccaacgtatttgggcattccagcataaagcgacgagaaggaacaatttggaaaatatttcctgcataaatatgctgttttaattgttcaataatggctttaaaagattcgtcttctaaatttacttgtactgcaacactcgcttttgagacagctaagtgcggttcaattttcgttaatttttgacaaatttccatcgcacttttttgcacattacctaattcttgcgaatgaaaacagaatgattgtagagtagtttgttgtaattgatgatcaatcaccaataaattttctgccaaataaaatacatagtcaggacaggttaatccatcatcttctaggctaatattttccattggtataaaattaattactaaatcataggcaaataatccccctagaaaaatgggtattttggattgagcataaatatctgttaaacaacgtaacccatcaaaaacggttgttgcctgtaatttgctatcttcatcgagattgggattaatcggagggataataacttctaaatcgctttcagacttcacaagtatttttgctgttggctgtaatttttctttaataagaggtaaaactgtttttccattgctggttaaagcgttaaatataatagtattaccgaaacaagatattttgattgcggaatttacaaacaataggctttttaaactatttttactggagatttccgcactttctaacaacaaagtattagttttttgttgacaaagtgttgcaaaaactgcggtaggatctttgtgataaggtaacttctgagttaatacttcaataaagggggtaaacataaaagaatccttatttagaataaatttaaatatgaactattaaactagtacagatttgttttgtcaatggtgaagtaacattattttaaaagtaagtatttgaaataaaaaaattgcaattttcttgcgagaaagcataagcaataaaattgcacttttaaataaattcgttatgataatcggttcataatttcacttatataaggaagaaaaaatgtggtctgagttattgattggttatggcttgtttattttagaaatactcacaattttattaattgttgcagggatagtgatgatgattatgacactgaaagaacgtaaatcacatcaagtcggagagttggttattacagatttatcacgagaatatgaaaataacagtaaaaaattgcgtgatttttacctgagtgacgatgcgttaaaacaacgtgaaaaagagcagaaaaaagccgataaacttaaagcaaaagaagaaaaagcccaacgtaaaaaaggggaaacgttagcagaaaaaagaaaaccacacctttttgtattgcattttaaaggtgatatttctgcttcagaaaccaccgcacttcgagaagaaattagtgcgattattgcggttgcaaaagaagatgacgaggttttattacgcttagaaagtcccggtggagttgtgcatggctatggattggctgcttctcaattagctcgtttaaaacaacgcaatattaagctaactgtagcagtggacaaagttgctgcaagcggggggtatatgatggcttgtgttgcagataaaattatttccgctccttttgccatcattggatctattggtgttgttgctcaaattcccaatattcatcgcttattaaaaaaacatgatatagacgttgatgtaatgattgctggtgaatataaacgcacaatgaccattttgggtgaaaatacagaaaaaggaaaagcaaaatttcaacaagatctagaagacactcatttattgtttaaacaattcgttacacaaaacagaccgcacttggatattgataaaattgcaacaggtgaacattggttcggcaaacaagcattagcgttacatttagttgatgaaattgcgacaagtgatgatttattgttacaagcaatcaaagataaaacagtgctttcggtaaaatatatgatgaaaaaatcactcattcaaaaattaggcaaacaagcagaagaaagtgctaataatgtgttgttacgattgctgaaacgtgatgagagtactttgatataagcttactcaacattgcccaaaaagagattaaaatttggtttacatttttgttgtttgatattaatatctcaagcagtgctgacgtgatttaatgcgacaatatttttgtaaagatagaaaattaaatcgtaagctattcaaaaaatttgaagaaatttatatacataaaattaaggtaaaataatgaaactatcacgttttgtattatctgctgttgtagcagcaacattgtcggcttgtggtaatttaagtaatgtcaccgaagagggtacatcagataacttaaagtggcctaaaattgatcagtcaagatttaatcatgatggtagccaatttggatcgtggccaaactgggataacctacgtatggttgaacgtggaatgaataaagatcaactgtataacctattgggacgtccgcatttttcggaaggtttatatggtgttcgtgagtgggactatgcttttaattatcgtgagaatggcgagcataaaatttgccaatacaaaattctattcgataaaaatatgaatgcccaaaatttctattggtttccaaatggttgtaacggttatgcatcttttagtttaaatacggatctcttatttgattttgatcaagatacgttgacctcaaaaggtgaagaagctgttgataatgttgcaatgcaattagaagcgttttcagccaaagaaattaaaattgttggttttactgatcgattgggtacagattcttataacttggatctttctcaacgccgagctgatcgtgttaaagagcgtttaattgaaaaagggttaaatattgatattatcgctattggatatggtaaaacgcaacagattaaggcttgcaatgatgtacctgccaaagaactaaaagattgcttacgtccaaaccgtcgtgttgaaatttcagcatacggaaacatctcaaaaaaatatggtaatggtgagctgaaggggggaacaaccggtccatcattatattacgaaaaataatctctcttgatataggtaagggcatcaaacgatgccctttatttatagaattatttatcacttttgtgcaaaatttgattaatcaatttctgagtgagagaaacataactttgctttttattataatagcgatagctgaaattgagcagataatagagctgataaataagttttctttctaagtaaccttcttccagtggatatatttcattatagcgttgataaaaattagttgggaaaggctcaaaaagtgatgaaaaagcaatatcgcattctctatctccccaatagcaagcaggattgcagacaaaaattttatcatctacttgaatacagttttcaatccataaattgccatgcagtatagagggtttggggttatgtttgctcaaagtatctgcaacaatttgcacgataagatctatatttccaaatatcaaacctttttctttacatacttgcaattgccagccaatacgattttcgctgaaaaatttagcccaacttgtctgccaatcatttggttgataaataggacctaaccaagtatcaaaatctaatccatacttatcaggcccttgtatttgatgtagctgtgctattttttcagcgaatattgtaaaagaagactgtttattctttgacttatttaacgcttctaacagtaaaaaactatgcccttgtgaattgccaattccataaactaaagggatattaattgaattagttttagctaaaagagctaactggtctgcttctgcacgaaacatagagcggtaggatctttcgtttattttaacaaaaacagtttgaacctcatcattaatcagccaaatttcattcatttcacctgaatataatttttctttatgtttaataaaatagtaggcaccaaattgttctgccagtacctgagaaatagatttccacatagctcctccgatatgattcaagttagcctgactagatgataatctgaataccggtaatattctgtgataaatatcaagttttaataaatatcttattaagtagtgaatttatgtaactcttatctatttatatctttactcatatgttatgtggattgaatatttcagcgaaatgataaggatataccaattagtctagttgttactaatacagtaaaatagatacgttttctaagagttttctgttaaaatgcaccgcacttttattgtacaaggtaggtataaataaaagtgcggtgctttcagcacttttttattttatgtttaactcaatttacaagtaacctttcgtatgggctaccactgtataaggattcacaatgccaattattactttacctgacggttcacaacgtcaattcgataatcccgtttctgtattggaagttgctcaatcaatcggttccggactcgctaaggctactattgccggtcgtgtgaacggcgagcgtcgagatgcctcagatatgattagtgaggatgccaatcttgaaattattaccgcaaaagatgaagacggtttagagattatccgacactcaacggcacatttattagggcatgctatcaagcaacttttcccaaatgtgaagatggctatcggcccaactattgacaatggtttttattacgacattgatttggaccgctctttaacccaagaagatattgataccctagaaaaacgtatgctggagctggcaaaaacgaattatgacgtgataaaaaaacgtgtcagttggcaagaagcaagagatacttttgaaagtcgtgctgagccttacaaaatagctatcttagatgaaaatattgcaaaatacgaccaacctgcactttatcatcacgaagaatatattgatatgtgtcgtggtccgcacgtacccaatatgcgtttctgtcaccattttaaattaatgaaagtagctggtgcatattggcgtggaaatagtgataataaaatgctccaacgcatttatggtacggcttgggcagataaaaaacaattagccgattatttacatcgattagaagaagctgcaaaacgtgatcatcgtaaaatcggtaaggcgttggatttataccatatgcaagaggaagcacccggtatggtattttggcataatgacggttggacaatcttccgtgagctggaaacatttgtgcgtacaaagttaaaagaatacgattatcaagaagtaaaaggtccatttatgatggatcgagtgctttgggaacgtacaggacactggcaaaattatgctgatttaatgtttactacacaatctgaaaatagagaatatgccattaagccaatgaattgtcctggacatgttcaaattttcaatcaaggcttgaaatcttatcgtgatttacctattcgtatggctgaatttggttcttgccatcgtaatgaaccatcaggatctttacatggattaatgcgtgtgcgtggttttacacaggatgatgcacatattttctgtaccgaagatcaaattgaatcggaagtaacgagctgtattaaaatggtttatgacatttatagtacgtttggctttaccgatatttttgtcaaactttctactcgtcctgaaaaacgcattggtgaagatgctatgtgggatcgtgcagagcaaggtttggcaaatgcacttaaacacaatggtcttgaatatgaaattcaagagggggaaggggcattttatggaccgaaaattgaatttgcattaagagattgtttagatcgtgaatggcaatgcggtacaatccaattagattttgcgttaccaggacgtctagatgccacctatgttgcagaagataatgcccgtcgcacacctgtcatgatacatcgtgctatcttaggttcaattgaacgttttatcggtattatcactgaagaatatgcaggttttttccctacgtggttagcaccgattcaagctgttgtgatgaatattactgatagtcaagcggattatgtgcaaaaagtagttaagcaattttctgaagcgggattacgtgtaaaagcggatatacgcaatgaaaaagtcggtttcaaaattcgtgaacataccttacgtcgagtaccttatatgctagtttgcggcgataaagaaattgtggaaaacaagatcgcagttcgtacccgtaaagggacggatttaggcacgtttagtgttgaagaatttgttgagattttaaaacaacaagtaagaaaacgtgagttaaccttgttaggtgaataatgataaaaaatataatcggcacttaaaggtgccgattttttatggaattgttcatttaatacagtaatgaatacaacaaacgacgaaatttatttgtaatcggatcgttattaccaatggcagctaaaatcgctaaaaattgttgcttagcctctccatttaacgcattaagatcttgttttaatatatcaaacagcaaatttaatgaagcctcattacgattggcttgatgcaattgtaatgctagttttaatgcaatttctgctgttggatttttagcaaaatcagcttgcaattgctgaatttcaggggtatcagtcgcttttattaaaagctcaatttgagcaattaaaccatgccagcgactatcacgatcttgtagcggaattttatctaaaatctcttgggcgggttcaatgcgttttatcgtaatataggtttcagcgtagagtagagcaatatcgctatttttcttatcagataattcccatgcttctttgagcaacggtagagcgtcattatattgttcttgttccaacaaatttaatgcctgattaaatttcatttcttcttccttcggtaaaattagagataaacgttgttgtaacataatttcatctaaagaaccttggaaagcatctaatacttgtgcttgattaaataaataagttgttggtaatgattgaatatgaaattgtgcagcaatcattttttccgtttcacaattcactttacctaataaaaattgtccttgatatttttctgcataacgagtcaaaagtgcggtaaattctaaagagattttgttacttggggtataaaaaattaaaacaagaggtgtttgtacagaactttgtaatacacttgttagattttgctcattaatatcaataatatatgacataaaatttcctacgtttatttaaaggtaaagtgggtaaattgtaacaaaccaatcatttttttggaaaatatttcttcgatttaagactttcttaatattttttaataatacaaaacagctaataaagaattcggtcaggatgctaaaatagatgtaacagaagtgcagaaattaataaaaaccttggtattgtttgatatgagactgatttaaaacgtcattataaattctccaaaatttaatcgctaaaatagaagatctttgctagaatccgtacgaaaaacacctttctaatgtttttcattttggttattaattcatttggaaacacatataatggaaaatcaatcttttctacaaaaatacttcaagtttaacgaaaaaaagacgactacaaaaacagaaatcattgcgggaattaccacattttttactatggtttatatcgtttttgtcaatccgtcgattttaggtgatgcaggaatggataaacaggttgtctttgtaacgacttgtttaattgccggtttgggaacaattgcaatgggattatttagtaatttacctattgcacttgcaccagcgatgggattgaatgccttttttgcttacgtcgtggtaggaaaactagggtattcttgggaaattggtatggggacaattttctggggatcggtagggttacttttactaactgtctttcaaattcgctattggctgatggcatctattccgctgagtttgcgtgtcggtatcggagctgggataggattttttattgctttaatcggctttaaaaatatgggactggttgtatctaatccggtaacgttggtttcgcttggtgacttacatagctcgcaagttttaatgggggttttgggattttttattattgtagtgttggctgcacgtaatatttattctggagtcttggtttctattgttactattacggctttagcattgatttttgatgaaaatgtggtttttaacggcgttatttctatgcccccaagccttgatgctgtagtcggaaaagttgatgttttaggtgcattagataccgcacttttaggcattattttttcttttttgttagtaaatttatttgattcatccggaactttgcttggtgtaacagataaggctggttttagtgatgctcaaggtcgtttcccaaaaatgaagcaagcgttgtatgtagacagtattagtgctgtaacgggttcttatatcggtacatcggcaatcagcacttatattgaaagtggtgccggagtgtctgtcggaggtcgtaccggaatgaccgctgttgtagtcggaattttatttttacttactattttcttctctccattggctggtatggtgccggcttacgcaacagcaggggcattagtttatgtaggtattttgatggcatcaagcttaattcgagttgaatgggacgatttaactgaagcaacaccagcttttattactgcagcaatgatgccattcacctattcaatcactgaaggtattgcctttggttttattagctattgtgtcatgaagacttgtaccggtcgctggaaagagattaatgcaccggtttgggttgtatctttgctttttgtagcgaaatttgtttgggttggataaatcattaattattgaatagatctttctaaagcggacattagtccgctttcttgttgatttaactagaattttgggatttttatggaacataaattagaagatattatttacatttttaatcgatgctttgagcaagagtataatacaaggttagttaaaggtggtgatgaaccgatttatattccggctaataaagattgctcttataatgctatctatttcgcacgtggtttttatagtagtgctttgcatgagattgcacattggcttattgcaggaaaagagcggcgaaaattagaggattttggttattggtatgagcctgatgggcgttcaatggaaaaacagcgtgaatttgagcaagcagaggtaaaacctcaggcattggaatggattttagcaactgcggcgggatttcgctattttgcgagtagcgataatttaaacggtaatccgggagatacacaaccttttaaattagctgtttatgagcaagttaaaacttatgcacaaaaggggttaccgaaacgagcagaaactttgcgtaaagccttagcggaattttataaaacagaagaccgcattgttctgagtaaatttgacgtagcgaggatataaatgttagctctggaaattaaacatttgacaaaagaatataaaaatggggttaaagcactatccggaattgatcttagggtagaagagggagatttttatgcgttgttgggacataacggtgcaggaaaatcaacaaccattggcattatcagctctttaataaataaaaccagcggaacaataaaagtgtttggttatgatttggatcggcaattagctcaattaaaacggcatattggcttagtaccacaagaatttaactttaatcaatttgaaaaaattcaagacattctagtgaatcaagccggctattatggtattgagcgaaaagaagcacttaagagatctgaaatatggctaaaaaaattagatttatgggaaaagaaagatcaacaagctatgcgtttatcaggtggtatgaaacgtcgcttgatgattgctcgagcattaatgcacaatcctaaattattaattttagatgagcctaccgccggtgttgatattgaactgcgacgtgctatgtggacttttttaaaagaacttaatcaacaaggaacaacgattattttaaccacacattacttagaggaagctgaaaatttatgccgtcatattggcattattcagcaaggtaaactgattgttgatatgtcgataaaagccttattgtcacagttagagacagaaacttttattttagatttagcactttctagttcaacgccaaaggttgataattacaacgtcacaattattgatgagctaacaatggaagttgaagttaagcgtggacaaggactgaataatttatttattcaattaaatggtcaaggaattaatgtattgagcatgcggaataaagccaatcgcttagaggagctgttcatttctatggcgttaaataaaccaaaaatcacggagaaaatataatgttagcttggattgcgtttaaaacaattttaactaaagaaattcgtcgttttactcgtatttgggtacaaactttagtcccaccggtcattacaatgacactttattttattatttttggtcatttgattggagcaagaattggagaaatgaacggctttagctacatgcagtttattgtaccgggattaatcatgatgtctgcgttgactaattcttttgctaatgtggcgtcttcattttacagtaccaaatttgctaaaaatatagaagaattactcatttcacctacttcttctcatattattattttaggatatatggctggtggtatagctagaggtttatgcgttggtattttagtaacaatcgttgctatgttttttgtggaaatgactgtctattcatggctaattattgtgttgacacttttaatgacaacagcaacctttgctttaggtggtttaattaatgctgtttttgcccgctcttttgatgatattagtattattccaactttcgttttaacgcctttaacttatcttggcggtgttttctattctatttctttgttacccgctttttggcaaaacatatctaaactgaatcctattgtttatatgattaatgggtttagatatggttttttgggggttagtgacgttggaattcattatactttcactgttctgacattatttattaccgcactttatggcttggcatactatctaattagtcgtggggtagggttaagaaattagccgtcagatcaatacaaacaaaggcgaataatcaatactcgccttacttttatgaacctaagttttttcctttaataaacaaataaatttgcaattgtttatatttgatctatttaggtagttttccttggttttctatttcatagcaaggttcataagcatcacctccaggtaatttcattctgtgctggttgatgaaatcttgcaataaattgtcgactttttccattaatacgggatcaccttttagtttgaattttcctaattctgtaattttatcttgagtatctggtttgatatttcccgctacaattcctgagaaaactcggcgtaaattagcagctaaatcaactttagattggtcaaaatgtaaagctaaatttgccatgttttcatgagttgggataaacggtttttgaaattcagcagtaatttctaatgaccagttgaaataatacgactcatttttttcataacgtgatttttggatgtcgcgcatagcattatttatatggcgagcaactgaaaccggatcatcaatgataattttatataaagattgtgcttcagatcccaatgtatcaccaataaattgatcaatagaagcaaagtaagccgcactttcttttggaccggttaagataagcggaagatgttgggcattrttatttggattgagtttaatgcctaaaatataaaggaattcttcaaaagttccaggaccgccggggaaaataataatcccatgtcccatacgcacaaatgcttctagacgtttttcaatatcaggcataataataagttcgttcacaattggatttggaggctcggaagcaataatagatggttctgtaataccaataaaacgactttgtttatagcgttgatttgcatgaccaatggttgcacctttcatgggtgcttccattacacccgctccacagcccgtgataatattcaactcacgatgtccaagttctaaacctacagaacggcaatattgatactctatttggttaattgaatgccctccccagcaaacgactaaatttggttgctcaccgttaattagggccttagcattgcgtaaaatggcgaagacttggttagtgatatgtttactatcttgaatatcacaagggttaatgcgttgatttaatacattaacaaataaaatatcacgtaacacagcgaataaatgatattgaatatttttaatcattttattatcaacaaaagcattttctggtggattatgcaattctaaggcaatgccacgttcttttgctaccaagttaatatcaaaatcaggatatttacttaatagctcacgactgtcatctgtaattgcacccgagtttaatacggctaacgaacaattacgataaagttgataaagtttacttttagcttttttagctagttgttcaacttccatgtgtgaaagttgatccatgcttcctttgggattaacataatgtatatttttcataaaagttcctttttattggcgtgcaagacgctggttaagtggaataggctcaaaattggaacgaaatggattaatatccaatccgcctcttcgtgtatatcgagcataaacactcagtttttcaggttgtgcaaatttcatcagatcacagaaaatacgctctacacattgttcatgaaattcattgtgttgtcgaaaggaaataagataacgcaagagtttttctctgtttatttggttaccaatataatgaatttgcacagttccccaatccggttgattggtaattaggcaatttgatttcagcaaatggctgactaatttttcttcgacccattgcttgttggtgcaattttctaataaatttggatcaaattcatagcatcgtatttcaatatcttgttcatcaatacattcaccttgtagagtagcgatgagttgttgagcataattctgtaacgaatttaaccgcacttttacttgcccttttgcacattttattaaatcttgttgcagtatttgttcaacctgttgtagattttcaaactgactttgattaaaactatttaaataaagtttaaaactttttgattcaatcagattttcactttgataatcaatttcaacatcagcaatagcaacttgaggaacaccttttaaatttagccaagaaatttcataggccgtccaaatatccgcaccgaagctaaagggctgttttgtactaatacctaaatcatctcggttaagtttgcgtggtaccgcttgtaataaagtgtggtcgtaagtagagatatattctgttttttttcctaattttaatgtttgtaaactttggtcatggtattgcatgattcatcctttttgttattgccaatgccaagataaattggaaactaggcgacaatgatcacatttaaaatgaaagagattaaataacggtttatctaaatgccatttttgctgacaattaggacataagcgttgttgttcactttgcagatcatcaccgccaatgcgataaagataataaaaagtgggaataccggtatgtttttcaatttcttgagtcagataatagccgtgtttagttaaatgactattgaaatcactgatttcatacagtgcttgttgctctaaaattgaaccgttcatttgcaattgatcacaagcctgccaattttcttgccatttaataatatccatactcaagtgcggtatgtttttaaattgtttatataatggaatgggcaataaattatcaccgctatgtagcggagaacaagactgcaagtacgttgtatacaacacttgccaagtcgctacctcttttgagtaagttatatctgaatttaaatcatccgcaatgatttgaaaactatcaaaaaaaatccccgcactttttgcttgttcaagggctttatctacttgtatgttattgaatgtaggtaacaaactttgctgttctggacaagttactcgcaatgcaaatccctcttcattattttgaactgcaacaaataatggaatttcacgtccaataatttgtccgttataacgccattgctcaataatttgattaattagataagaaatattactaattggcaatttttgaggttgtcgataggtaaaaaatacttcaactagatacatatttattgtttgatgattattcgaaagggtagattaacataattaatttgcatagaataccgctttttattttggaatataacgcatgaaaattgaaatcaaaacgcacttacaagcgttacaaaaaattatgcaggacttagaattatggcaatcctttccgcccgatgaacaggctttttcaagcaccgcccctttttctatggatactatgagtgctaatgaatggttacagtgggtttttatccctcgtatgtatgcattgctggagggtcaacaatctttaccgtataaaatggcaattacaccttatatcgaagaagcattaaaagatcttgatggattaaatgacctactacagcctattcatgaaattgagaaattatgtcagagccaatagaattggatattttatatcaagatgagtttctcgttgtagtgaataaacctgccggaatgttggttcaccgcagttggctagatcgtcatgaaactcaatttgtcatgcaaactttacgagatcaaattagtcaacatgtttttcctattcatcgtttagatcgtccaacatcaggtgttttactttttgccttaaatgctggaattgctaatttattatgttcacaatttgaattaaaacaagtgaaaaaaagctatttggcgatagttcgtggttatttgagcgatgctcaacgaattgattatccgcttaaagtgcaactggacaaaattgcagataaatttagtcgaaaagaagaactgcaagatgcaataacggattattatggtttaaaaaccgttgaaatgccttatggcgtagggcgttatagctcttcccgctattcacttgtacgtttaatgccttatacgggacgtaagcatcaattacgtcgccatttaaagcatatttttcatcctattttgggtgatactcaatatggtgatttacaccaaaatcgggctttcagtcaaaatcttggtgtaagcaggttaatgttacatgctgaaaaactttgttttcaacatccggtaactaatgaaacaatagaaattgttgctgatttagatgagcaatggaaattgttattcaaaatatttaattggtaaatagctcagaacatttgaggaagtatatgttaaataatgtaaaattaactcatgaagaacagcaaagtgcggtagaaaaaattcaagaattaatgcgacaaggtatgagtagtggggaggctatagccttagttgcgaaggtgttacgtgaaaaaaagttacaccctgaatcaaaatataatgaaattttgtgatctctgtcggatttttgaatattatttattgcaaatatagttaatttcgttgagtatttagttaaattttaggaaggtggtaaggctcacagtcttattatgaagtatagaggtctgtaaaggcttaaaaccaaagaggttaaaatattatggaagtaggtattgttaagtggtttaataatgcaaaaggatttggattcctgtctgttgaaagtagtgatgttgatgtttttgcacattattcagtcattgaaatggaaggatatcgttctttaaaggcgggacagaaagtacaatgtgaagtcgtgcatggagataaaggttctcatgccacaaaaattatccccatggttgaataataaaatcaaagctttttgtttcggtgtattgagcaaggttttaaccttgcttttttatgtgataaaactcgctattttagcagatctttaagaccttctttcataacggaaacttgattttcatataagaccttgctttctctttcatcaatcatataagaaatagtttccgataaagtcattttcattttacgtgaataacgagataatcgaagccagaccgcatattctagatcaattgattttttctttgtagattgtttctcgccattgaaaaaacgttttcttcttgctcttatagcttgatccaacttaataactaaatttgatgacaaatgattttctatccaatcttcaattttttcagggtagttttggtgtgtcattaattgccgaacaatgtcttcttgtaaactttgttctgtataacgtgtaatattttcaccctcgcgtgattttttgatcaaatagatccatttccaatttgcttcttgatttgtcagcttctgatatttcattttgtttactcatctgtgacattgtaacctatgtaataatatacgctttttatattattttctagtaaattttaatcaagaatacagaagtgaattaaatagaaatatgcgataatatgaccttaatcgtttaatttgatagagagtacatgtgacaattgagcaaaaaataaaaaaaagagccgacgaatgcttgtcagaacagttaatttcttggcaaaatttattacccatgttacaacttgataatgattttttagacgcttcattatctgagattgatttttttactttgcaaccaagagctaaaagtgcggttgatcttttcctaaaaaatcctcaacgatcattgcttgttttaaaagcagatgatcaagctgaatatgcaactttactacaagaatatatagagcaaaaacttcctgtttctgaaacaattagtggtgttcagtatattattgaacagggagacagtttttcttttccacaaatcagtctagcacaggcagcatcaatggaagacaactttgcaggaaaacaaaaagtggcaagtgctttatttttcgatcaaagtcagttattcggatcagttgtaattcaccccagttctcatgatattcaacttaattcaggattagtacatcaagtaaataatggtgtattgattttgagtgccggtgcattgttggagcaatttgagatatggcatcgtttaaaacacttattactaacaggtattttcagttggtattctcttaatcctttgaaaacattaccttgcacaattcctaattatcccttaaatctaaaagttatcattttaggtaatcgttcagagttggcaactctaggtgaattggaggaggaactgtatcatttcgcagattatgcagaaattgaaagttatttttcgcttaatgatgcacaggctcatcaaaagtgggcaagttatgttcatacgttggcaaaaaaacaaggaattgagctgagtattgaaggaataaatgcactttatcaactttttgtgagagaaagtgaagatcgttacttaattagtatctcaccattaaaattaaaagggatcttatttgaaacacaaattttaagtcaaagaaaacatttaagtgcggtagattttcaattattttttcaacaaaaagaacaacagtactgtttcttacgtgagcaggcgtataaaggcattttacaggagcaaatttttattgctacagatggggaaataataggacaaattaacggattatcagtcattgaatatcccggtacaccggtttcttttggcgagccttcaagaataagttgcattgttcaatttggtgatggtgaagtaattgatattgaaagaaaaagtgatctggcagggaatatccatggcaaaagcattatgattgcagaaacttgtcttgccggcattttagatcttccttctcaattacctttttcagcctcaattgcatttgagcaatcttatggtgatattgatggtgatagtgcgtctttggctgttttctgctcgttattaagtgcgttggctgatttaccgttaccacaaaatattgccgtaacaggtagtattgatcaatttggtttagtgcatgctgttggtggtgttaacgataaaattgaaggcttttttgaagtttgtcagcgtcgtagattaacgggaaagcaaggtgtaattataccaagtgcggtattaaatcaactcagtttatccggtaaagtaatcgaagctgttcaacaagaaaaattctttatttgggcagttgacgatatttttcagactactgaaatcctatttaagcgatatttagtaagcgaacaggatgctggattggaaaaaaatcttcccctcgtagatgtgattcgacaacgattagaagagagatctgaacaacagcataaaggtcgtttttggaactttttctttaatcgccattaaatgttaagaaacacgtgattttttaacaggttagtattattattaggggcattttcgtttaaacattggatttttaattatttagaggacaggtatgtataacctacaagaaattactgaagaagcacggaaagcaattgaggcactgcaagataagagcattgaaagcttggaggcaattcgtgtggaatattttggtaaaaagggacattttacacaattaatgcaagggttacgtgatgtgtcggcagaggaaagaccggcagttggtgcaaaaattaatgaagcgaaacagaaggttcaagcgatattaaatgcaaaaaaagtggaatgggaagaaatagcgttaaatgaaagattagcccaagaacgaattgatgttagtttgccgggaagaaaaatggaactgggagggttacatcctgtttcaattactattaaccgtgttgtacaatttttttcaaaactaggatttactgttgagataggtcctgagattgaaacggattattacaattttgatgcgttaaatattcctaaacatcatcccgccagagctgatcatgatacattttggtttgatgcagaacgtttgttacgtactcaaacttcaggagtacaaattcgtactatggaaaaaatgtgtcctccaattcgtattatggcaccgggcaaagtatatcgtaatgattatgatcaaacgcatacgccaatgtttcaccaaattgaattattgtatgttgataaaaaagctaattttactgaattaaaagggttgttgcatgatttcttgcgagctttctttgaagaagatttacaagtgcggtttcgtccatcttattttccatttacagaaccttcggcagaagtggatgtaatgggaaaaaatggtaaatggcttgaggtgttgggttgtggtatggttcacccgaatgtgttgcgtaatgtgggtattgatccaaatgagtattcagggtttgcagtcggtatgggagtagaacgtttaaccatgttacgctacaacgtcacagatttacgttcattttttgaaaatgacttacgttttttaaaacaatttaaataataagggcaaaaaatatgaaaaaattaatatcagtcgcgttggttatgttttccccttttacattcgctttttcacagggacaagttaaattgcctatgcaggaaaaacaaccggcagcagtcattcgtgtatttgataattcggttaaaccctataaaatcattgaaggaaagaaactatctcgtagcaaaccacgtcatctttgtttatatatacttaatgtcgatcttcaggaaagaaatcttttagctcaatatgtacaagctcctgcaccgataaaggtaaatgtgccgaatgttaatgctaaagtacgaatggaagataaccagaagaattttttgattatgtttgacatgatgaaaaaagatattagaaataatacacctactctatgttgggcacttggtacagatgaccctatcggcatttacaaattggatgtgcaatttaataatgttgtgtttgaaaacttagaatttgaattattaaaatagagagagaattataaatgaagtttagtgaacaatgggtgcgtgaatgggtaaatcctgcaataagtactgaacagctatgtgaacaaattacaatgctgggcttagaagtagatgatatagcaaaagtcgcagcagatttttcaggggttgtcgttggtgaagttgtagagtgtgctaaacatccggatgcagacaaattacgggtaaccaaagttaatattggtggcgagcgtttattagatatagtatgtggggcaccgaattgtcgcaaaggattgaaagtcgcttgtgcaatagacggagctatattacctggtaattttaaaattaaaaaaactaaattacgtggtcagccatcggaaggaatgctatgctcctttaacgagcttggtattaatgaggattccagcggtattattgaattaccgcaaaatgcaccgataggtgttaatttacgtgaatatttaactctgaatgataacaatattgaaattagtctaacaccaaatcgtgctgattgtttaagtatagccggaattgctcgtgaaattggtgtagtcaataaacttgaactaaactcaccgcactttgaaccggtcaaagcaagtattaaagataaagtcactattgaagtattagcacctgaggcttgcccacgttatcttttacgtgtggtgaaaaatattaatgttaaagccgacacaccgatgtggttacaagaaaaattgcgtcgttgcggtattcgttcaatcgatcccgtggtggatataactaactatattttgttagaacttgggcaaccaatgcacgtatttgacatggcaaaagtgactcaacctgtacaggttcgtatggcaaagcagggggaggaattggttctattggacggttcaacagcaaaattgaaagaaaatacgctgataatcgcagatcaagaggggccgttagccatggcaggcatctttggcggacaggcaagtggtgttaatgcagaaactaaagatgttattttagaagcggcattttttgcaccattggctatttcaggacgtgcaagacaatacgggttacatacggattcttcgcatcgttttgaacgtggtgtggattttgaattggcacataaagcaatggaaagagcaaccgcacttttaattcaaatttgtggcggtgatgccggtgaaatttgtgaggctttaagtgaagcacatttaccaaaagtaaaacaaattcagctacgtcgtacgaaattagatacgttacttggccatcatattgaaacagaaaccgttactgatatattccaacgtttaggatttgcagtggaatatgcgaatgatgtctggacggttacttctgcaagctggcgttttgatattgaaattgaagaagatttaattgaagaggttgcccgtatttatggttacaatgtgattccaaataatgcacctttagcacatctacaaatgaaggaattaccagagaaattattagatctcaatcgtatccgtaccgcatttgtggacagcgactatcaagagattatttcttatagctttgttgatcctgacatacaaaaattgttacacccagaactagatgcacttgtattgccaaatccgatttcaaaagaaatgtcgacaatgcgattatcgttattgccgggcttgctgagtgcggttgtatataaccaaaatcggcaacaaaatcgaattcgtttgtttgaggcaggattacgttttgttcctgatactacagcagaatgcggtattcgccaagaatatgtgattgggggcgtgattgttggtgataaacgtcctgttcattgggaacaaaaaggtgaacatgttgatttctttgatttaaaaggtgatttagaacatattttgtctttaactcacgttggacatcgtttgcgtttcgtggctaaatcttatcctgcactacatcccggacaatcggcagaaattttacttgataacaaagaaattggttttatcggtgcagttcatccaaaaattgtacaaaaattggatttgtccggaaaaccgattgtattccaaattgaatggaatgcgatttctgagtgtgatgtccctactgcacaagaaatttctcgcttcccagccaataaacgtgatcttgccattgttgtagacgctgacgttgtggctggagaagtactggaagtttgtcgtgctgttggaggtaaacaacttattaatgtaaatttatttgatgtttatcagggggtaaatctacctgccgataagaaaagtttagcacttagcttaatgattcaagatacagagaagacccttgaagaaaaagatattaatgcggtaatatctgttgtattatctgcgttgcaacaaaattttaatgcttacttgagagattgattatggcactgactaaaattgaacttaaaaatagcttgattgaacagggtttaaataaattagaggcgaagaaagtagtagagggcttctttgaacaaattcgagtttcattagaaaatggtgaagatgttaagttatccggatttggtaattttgaattaagagataagtcatctcgtccggggcgtaatcctaaaacaggtgaagctattcctgtttctgctcgtcgtgtcgttgtattcagaccgggacagaaattacgttcaagagtggaaaaaaccaaacctaaaaattagggattttttgtttctttaagaaaagccgtttacattaagtaaatggcttttatattttaacgtaatagaaaaggtgtaatggacaaaatagttgctaaaaagtgcggtcagtattttatttttttacaccgcactttcttaccttaatttacctctttgaaactaatcatttcgccttgaataaaatctattttttcatcgttttcttgaacgaggggagtaggtgagaacgcttctttatcaaaagcaatatcaccttctattccttccggaatctttccatgtcggatacgtttaaaatcaaataagttagaatcacataaatgtgaaggcacaatattttgtatcgcactaaacatagtttcaatgcgtccaggatattgacgatcccatttttgcaacatttctttgacaacttgacgttgtagatttggttgagaaccacataaattacaaggaataattggaaattgtttggcaactgcatatttttcaatatctttttctttacagtaagccaaaggacgaataacaatctgtttgccatcatcactgatcagttttggcggcatagattttaatttgcccccataaaacatattcaaaaacaaagtttccagcatatcatcacgatgatgtcctaaagcaattttagttgcccccaattctgttgcggtgcggtataaaattcctcgacgtaaacgagaacagagagaacaagtggtttttccctcaggaattttttcttttacaataccatatgtattttctgccacaattttgtaatctacactaatgctttttaaatattcgggcaaaatatgttcaggaaagccaggttgtttttgatccaaattcactgccacaatatcaaaatgaataggtgcattgaggcgtaaatttaataaaatatctaacaaagtataactgtctttaccaccggataggcaaaccatcactttgtctccattttcaatcatattaaagtcagcaatagctttgcctacattgcgacgtaatcgcttttgtaatttattcaagttataactttgttttttatctttttcggtaatgatatttaaactcatacagtttctgatcttgttaagaatgcgatatagtaaaggggaattgccactttgccaacagaaaactgtgtttttaatgatctattatttaaattaagtacgagataaaagtgcggtagtttttagtcatatatctattagaaaaagcaaaattacgctataatcttgcacaattttgcgtaagttattgcattgtgagaattgttaatgctcgaaacatcacaaactattcctgaattagtcaactggacgagagaacgagagctttctttgagtctatctacagaacgcttggcgtttttgctggctattgctatttacaataatgaaagacttgacggtgaaatgttggaaactgatctcattgatatttttcgccatatttcaaacacgtttgaacaatctgctgaaactgttagtacaagagcgaataactccatcaatgaattagtgaaacaacgttttttaaatcgctttagtagtgagtttactgaagggttatctatttatcgcttaactcctttaggtgtaggggtatccgattactatattcgccagcgagaattttccgctttacgtttatctgttcagctttctattgtagcagatgaaattcaacgagcttcagaatctgcggaagaaggcggtgatgaacattattggcgtaaaaatgtatttgcaccattgaaatattctgtagcggaaatctttgatagcattgatttatctcaacgtatgatggatgaaaatcaacagcatatcaaagaggaaattgctgaactgcttactaaagattggcaaacggctattgccagttgtgaacgtttattagatgaaacctcggggaatttacgtgaattgcaagatacgctcaatgctgccggcgataaattacagtctcaattgttacgtattcaagactgtgtaatagggcatgacaatttgtattttgttgagcaacttattgtagatttacaagcgaaactcgaccgtattataagctgggggcaacaagctattgatttatggattggttacgatcgccatgtacataaatttatccgtacagccattgatttggataaaaatcgtgtcttttcacagcgtttacgtcagtctattcatcattattttgatcatccttggttcctttggatcgcacaggctgaacgcttaattgatctgagggaagaagaattaacactacgtgaagaagaagcccttggggaactgcctgaagaattgcaatatgaatcccttgctgatttacatgagcaaattgtggaaacaatgcaatctttattaattgaatatcgtctacaaaatacccctattgatttgagtgaggttttgaccgctcaactaaaacaatacccacttgctaaacattttgatatagctcgtattattattgatcaggccgttcgtttaggtttagctcaagatgatttaaacggtatttatcctaattggagatcgattaacgaaaatggtgcagaagtacaggctcatgtaattgataaatattaacccaatttaaccgcactttttgtaactgattaatttaacaactttctgaaaagaaaagagaaaaatatgacagataatattcaagatttactttccattaaattagctagagctattgcaaatcctttattccctgaagtggatagccaattgcgttcaggtaagcacattggacaagagtatttagataattattcatttttggcagattttcaacatgaattagatagtttctaccggcgttataatgtggaattgattcgtgctccggaaggatttttctacttacgtccaaaagcaaccacgttaattgctcgctcagtgttgagtgaattggaaatgttagttggaaaagtgctttgttacttgtatctcagtccggaacgtttggcacaacaagggatttttactgttcaagaagttcatgatgaattgatcaacttggctgatgaaactaagttattgaaagcaattaatttgcgtgcaggtggttctgatttggataaacaaaaattagcggaaaaagttcgttcagctatcagtcgtttacgccgtttaggtatgattcatgcggtaggcgatcaacatagtggtaaatttacgatttctgaatctgtgtttcgtttcggtgcagaagttcgttcaggggacgatccgcttgaggctcaattacgtttaattcgagaaggggaagcggcaacggctcaatcattacaagaagaaaaaaatggcttgaaagataatatggatcaaagtgcggtagaaaatgaacaatattttgaaaatgaagaaaatgaggggattgcataatggtagatttagcgttacagccgaccatgtctgaagaaaacatcgatcaagttgaactacaggataaacaagaatccctcgaaaattttacggcattttcgccttttcgttctcaggggggagtggagcgaggtaagtttcgttctttaaccttaattaactggaatggtttttttgcccgcacttttgatttagatgaattagtaactacgctttcaggcggtaatggtgcaggtaaatctacaacgatggcaggatttgtaactgcacttattccggatttaactttattacatttccgtaacaccactgaagccggtgcaacaagcggttctcgtgataaagggttacatggaaaacttcgccccggagtttgctatgcggttttagatactattaattcacgtcatcaaagaactttagtgggagcaagattacaacaagtggcaggtcgtgataaaaaagtagatattaaaaccttttctgttcaaggcttagcattatcacaaaatccaaccgcacttttcactcaaataattgatgagcgtcaagcgaggatattaaatcttaatgaattaaaagacaaagttgaaaaactcaatgctcaattcaaacaatatcattcaataacagattatcatgcgatgatgtttgatttggggattatcccgaaacgtctgcgttcttcttcagatcgcagtaagttctacaaattaattgaagcatctttgtacgggggtatttcaagtgccattacccgatcattgcgtgattatttattgcctgaaaatttgggggttcgtaaggcttttcaggatatggaatcagctttacgtgaaaaccgtatgaccctagaagccattaagattactcaatctgatcgtgatttatttaagcatttaattactgaaacgactaattatgtagcatcggattatatgcgtaatgtcaatgagcgtttaggtaatattcaacgtgcgattaattttcgtcgagattggtataaagcaaaaggtgagcaatatttatcacaacatcgcttagtggaattgagtaaagaagctgctgatttggctgaaaatgagaaaatcttagaaatagatcatcaaagtgcggtagatcatttgaatttagttctaaatgctttacgtcatcaggaaaaaattgaacgttatcaacaagatgtgcttgaaatcacagaacgtttagatgagcaaactttagtcgtggaaaatgcgaatgagcaggtaattgacactgaagtacagttacagaatgtagaaagtgaattggatcagattcgtaatcaattagcggattataagcaagccttagatgcacaacaaactcgtaatttacaatatcaacaagccatacaagcattagaaaaagctaaacatttatgtggattacctgatttagctgttaaaaatattgacgattatcaccaagagtttgcggttcaagctgatcaattaactgagaatgtactggatcttgagcaaaaaatgtctttgacgcaagttgcaaaaacacaatttgataaagcttatcaattggtatgtaaaattgccggcgaagtacctcgttcagcagcatttgagcaagctaaggaattgttgagagagtatccgacacaaaaaatacaagctcaacaagtctctcaattaagtgctaaattacatgagcttgagcaacgttatcaacagcaacaaagtgcggtacgtttattaaaagaactgaatcagcgtgcggatttacaggtcgatgaagcagaacagttggaagattattatgtagaacaagaagcattgattgaagatttaaccgacaaattatcagagcaaatagaaaaccgctctgtcttgcgtcaaaaaagggagcaactaactgcacttcatcaagaaaatagccaaaaagcaccggcatggttaacagcccaagccgcattggagcgtttacaagaacaaagtggcgaacattttgcagatagtcaagatgtcatgaatttcatgcaagcacagttgattaaagaacgcaacttgacgattgaacgtgatcaacttgagcaaaaacgtcagcagttagacattcagatttctcgtttaagtcagccggacggctcagaggatgctcgtttaaatatgctggcggaacgtttcggaggtgtgctgttatctgaattatatgatgatgtacctattgaagatgcaccttatttttctgcgttatatggaccggctcgccacgccattgtagtacgagatataagtgcggtgaaatctcagctggataatttggaagattgccctgaagacttgtatttaattgaaggcgatccaaccgcatttgatgacaatgtattggattcaaaagaattggctcatggggtagttgtacagatttcagatcgtgagttacggtattcgaaattccctgaagttcctttatttggtcgagcggctcgagaaaaacgtttagaagaattaaatattgaacgtgatgaaatttcggaactttatgcacaaagagcttttgatgtacaaaaatgtcaacgtttgcatcagcattttagccagtttgtcgggttgcatttggctttagcatttttacctaatccggaacaaactattgctgaaattaatcagcaacgcaatgaagtagatcgtgaattaaatctacttaacagtacagaacaacaattgcgtcttcaattggatcaagccaaagaaaagtggcaattacttaacaaattaagaccgcactttgctctattggctgaggacagtttaatagatcgtattgaagaatgtcgtgagcaactggattttgcacaacaagatgagttgtttattcgtcagcatggtgcgaatttatcgcaacttgaacctattgtaagtagtttacaaagcgatcctgaacattatgatcgtttaaaagttgattatgacgaagcagttattttgcaaaaaaaagtacagcaatgtttgtttgctttatctgatgtaatgcagcgtaaagctcattttgcctatcaaaatgaagttcaaaccgaaacttctgatttgaatgagaaacttcgtcaacgtttagagcaaacgcaacaacagcgtaatgatttccgtgaaaaattacgtcaaaagcaagaacaatttgcccaatataataaagttttaattgagctgacatcttctttgcataataaacaacaagtactaaatgagttgttacaagaagtaggtgatcttggtgttagagtagttcaaggggcagagcagttggctcaatctcgtcgagatgagttatatcaacaactttctatcactcgccaacgtcgcactcatgtcgagaaagaattaactcgaattgaaagcgaatcgcaaagcttgcatacccgtattcgcaaagcggaacgagaatataaggctcaacgtgaaacagtagtagcggcgaaaattagctggtgtgtggtgatgagattatctcgtggcagtgatgtcgaaaaacgtctaaatcgccgtgagtttgcttatttatctgccaatgaattgcgttctatgtcagataaagcccttggtgcattacgtcaagctgtagcggataatgaatatttgcgtgattcattgcgaatttccgaagatagccgtaaacctgaaaataaagtgcggttctttattgcagtttatcaacatttgcgtgaacgtattcgccaagatattcttaaaacggacgatcctattgatgctattgagcaaatggaaattgaacttaaccgtttaactaacgaactgactcaacgagaacaaaaattagcgattagttcagaaagtgtggcaaatattatgcgtaagacaattcaacgtgaacaaaatcgtattcgtatgctaaatcaaggtctgcaaaatattgcttttggacaagtcaaatctgtgcgtttagtagtgaatattcgtgattctcatgctatgttgctcaatgccttatctaatgaacagaccgaatatcaagaactctttacggatactcgcataaccttctctgaggctattgctaagttatatcaacgccttaatcctcatattgatatagggcaacgtaccgcacaaacgattggtgaagaacttttagattatcgcaattaccttgatttagaagtagaagtctatcgtggtgcggatggctggttgcgtgcagaaagcggtgctttatctaccggtgaagctattggtacgggtatgtcaattctcttaatggttgtacaaagctgggaagaagaaagtcgccgtattcgaggaaaagatattattccttgccgtttgttattcctagatgaagcagctcgtttagatggtaaatccatctcaacgttatttgaattgtgtgagcgtttagatatgcaacttctcattgcagcacctgaaaatattagtccggaaaaaggcacaacttacaaattggtgcgtaaaatttcaggcaatcaagaacatgttcatgttgtcggattgcgtggatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcattatctgattcttgccgttttatgtagtgtttccgtttccgttttatttaaatacaccaaaaaatatcaaattgtaaccgcacaaatgattgcatttggttatgtggttgccttgtcattgagctattttttattagcacctaattttaagggacttacttttaccgaattttttgcacaaagtgaagctaagccgatctttatcagtttagggattttattgcctgtcggttttttagtgatgtcgaaagcagtggagtatggcggtattattcgcacagatgctgcacaacgtttggcattgttcttgcaaattatcgctgcagttgtgattttcggtgaaaccttaagcgatatgcgaattgtcggtatcattgtcgcatttttcgctttatttttcctattaagcaaacctgccggagggataaaaagtgcggtcaaagccgcttttgctcttgccggcgtttggttaatttggggagcaacagggattttatttaagaaaattgcactaatgggcggtgcatttcctacaaccttgtttatcacttttgtcctagccggtgtgattatgtttatctacctattaatcaaacgcactaattggacagtatccagcctgattggtggcattattttaggttgtttgaatttcggtaatatcctgttttatatctacgcacatcaacatttcaaagaaaatccaaccattgtttttgccacaatggatctcggcgtaatctgtcttggtacactagtcggtgcaactatatttaaagaaaaaatcagcaaattcaatggtattgggatcttattaggtcttgtcgctattttgttgttacgggtttaggggaaaattaaatgataatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaatgttttaatgaattgtacaaagtgcggtaagttttttaaggtttttgtatatgcaaaatgatttcagtttttttatctacgattacgaaagttttgggattaatcctgccactgacagaccggctcaattcgccggtattcgtacagatcaagattttaatattattggcgagcctgtaatattttattgtaagcaaaccgatgattatttaccgtcgccggaatcggttttggtaaccggtattacaccgcaaatttgtaatgagaaaggtattcccgaaccggaattcgcagagaaaattttagctgaatttagtcaacccaacacttgtattatggggtataacaatgtccgttatgacgatgagatgacacgttataccttttatcgtaactttattgatccctatgaatacagttggaaaaacggcaattctcgctgggatttaatagatgtagtccgagcttgttacgctttacgtccggatggaataaattgggcttacgatgatgatggaatgccgagttttcgtttggaaaaattaacacaggtaaatggtatagagcatggtaatgctcacgatgcaatggctgacgtctatgccacgattgcaatggcaaaattgattaaacaaaaacaaccaaaactttttcaatttttctttgaaaatagaggaaagagggaagttgagaagttgattgatatcgctaatatgaaacctttagtacatgtatcaggcatgctgggtaattatcgaggcaacaccagctgggttgtgccattagcttggcatcctataaatcagaatgccgttattgtttgtgatttagcaaaggatattgatgacttattggctaaaagtgcggtcgaattacgtcaaaatttgtatacaccaaaagttgaattggaacaacataatattttacctgtaccacttaaattagtgcatattaataaatgtcctattcttgctcctgcaaaaacattattaccggaaaatgcaaccaaattgggaattgatcgagaattctgtttgcaaaatttgcaaaaactgcgtcaatctccagatattcgagataaggtcattgaaattttccatgatgaaagagaagtaatacacagtgataatgtagaaactgagttatacaatcagtttttcagtaataatgataaaaacaatatgacgattttgcgtcaattatctccggagaaattaaacgagcataatttatctttttcagataaacgtatcccggatttattatttcattatcgagcaagacatttctataaaacgcttgatcgctctgaacagataaaatggcaaaaatatcgccaacgtaaactggaaaaaagtgcggttcaatttgaggaaagtttacaacgtttagtagaagagtatcaaaataatcctgaagaattattgttgttacaacaagtatatgaatatggagcaactttacttagtaagttatattgataatagcaatatctagaaatgcaggattaaaaggtatttggtaaataaaataaaagagacaacgtaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatcggaagattgttatcttaatgatgcgttggcatggttcaaaaataatgggattgatttatacgctgttaatatcaatcctgaacaatctaagtttaccagttctcctaaagcctatggagatcttattattgatgatattgcattaggcattccgaaatggtcctgccatttttatcgcccttgtgttgattggaaattggtatcggaaatgctgtatagtcaaaaattgctaacnnnnnnnnnnnnnnnnnnnnnnnnnnnnnnnnnnnnnnnnnnnnnnnnnnnnnnnnnnnnnnnaaaagcaacgttcacagctatgcgaggacgttgctttttttgtagtttttatttattaagctttttctccttaagaccacactacaaaactattacaaatcatctctctatttaataaagttaaataataatacctttcaatgtacaagggagtctttatccgtcttgcttagctggtataactggcttgtgcataactttgtgatttaattaattcgtagttttcactaaccgcataactaatttcayataatgtatattatgttaaattaaataattaaatatgtaactttttggctggtttgcccctctattttgctatgaaatcttctgttaattagatgagattaaaaaaataaaaacgataaaaataaaagcgagttttttatttttttatgtttgatacagtgtcactaaattnnnnnnnnnnnncataaaaaaagccccatgattttcatcatgaggcttaaaattttgaaaactttatttatacacgtttaaaatcaatatggactaattttggcttgaatggatggcgttgcatcgcttgtactttaacagaaatttccttcccttcaataactaggataatagtatccgaatagaaagaatcatgaatttgagcgttatttaattcatcatgatttaatacaattgaaacaggtgcttcactaccaccataaacgatagcagggatttgaccattatgacgcaggcggcggctcgcacccttaccttgcttagaacgaacttcagcgttaaatttaaatgacattttttatgttctcttgaataaaataaaaaaacaaaaaaaccgcaggcgacccagcgatttcccttacgttatgctaaaacttatagtcatgttttagacatggtgctgattataatgagttattctctataaatcaaataaaacattgaatttaaactggatatttctactaaaaaagctaaaatagccgtcatactttcttattataaatgggtagttcatggacttattaattaatttttttactgattatgggtattttgcagttttctttgttctcattatctgtggctttggagttcctattccggaggatattactttggtttcagggggggttattgcaggtttataccctaatgaagttaatgttcatatcatgctgattgtgagtatgcttggtgtgttaattggtgacagtacaatgtattggcttggtcgcatttatggtgtgaaaatattaagaacccgtttaatcaaaaaaatagtaacccttaaacgtttaaaaatggtgaaagaaaaatttgctaaatatggcaatagagttttatttgtggcacgttttttacctggtttaagggcaccaatttatatgatatcaggcattactcgtcgtgttagttttattcgttttctcctaattgacttttttgctgcaattatttcagtgcctatttgggtatatttgggtgattttggtgcaagcaatctagactggttacatcaacaaataaagaaaggtcaatttgcaatttatatcttaatacttctactcgcattgttcttattttggaaatggaaacgtagtaagaaaaaagatatgtaatttagaccatcttacagggcgtatttaattatgccctattttatttacggtatagtgattcgtaaaaaataaccatactcttctactttcgatacactagatatcgtataaaatattggggatatataatttaaaaagggtactataaaaagtaccctaatttatctttaaattaaagtgcagattttgctttctcaactaatgctgtaaaagcaactttatcaaacacagcaatatcagccaaaatcttacgatcgatctcaacagatgcttttttcaaaccgttgataaatttgctatacgataaaccgttttgacgagtagccgcattgatacgagcaatccatagttgacggaattgacgtttacgttgacggcggtcacggtaagcatattgaccagctttaattactgcttggaatgcaacacgataaacacgtgaacgtgcaccataataacctttagctgccttaagaactttcttatggcgtgctcttgcaataacaccacgtttaacacgagccattatctaatctcctattgtccatgaatcttaaaaaatttaactaatcgtatgattgtgcccaaaacgctatttatgcgtatggtaagcacgctactactaaaacttggtctgctttcgcaaccattgatttatgacgtaaatgacgtttacgtttagttgtctttttagtcaaaatgtgacgtaagtgagattgtttacgtttgaaaccacctgaagcagttttcttgaaacgcttagcagcaccacgtaaggttttaattttaggcattgtttataactccgcattgtttaagtttaacatcagataattaggcgaataaaaatacggcaattcataccgcactttactacttgaatttgcactaattatttcttttttggggcaagtaccataatagcttggcgaccttctaatttgccaggtgcagattcaacaacagcaatatcagcaagatcatttttaacacgttctaacatgtctaaaccaatatcttggtgagccatttcacgtccgcgaaaacgaacagtgattttagctttatccccatcctctaaaaagcgaatcaggctgcgtagttttacctgatagtcgccttcgtctgtaccaggacggaatttaatttccttcacttgtacaactttctgctttttcttctgctcttttgcagctttacctttttcataaaggaacttaccgtagttcataatacgacataccggtggttctgcatttggactaatttcaacaaggtctaaatctgcttgctctgctatatttaaagcttgttggatagatacaatacctacttgttcgccatcttggtcaatcaaacgaacttctttcactctaatttcatcattaatacgattagggcgatttgttgccggagctttttttacggttttaataatgttattcctctaacgattttaaactaccatcaaactgcaatactgcagaagacataaacgattgctgtatttttagcaaaaaacggcgagattttataagattttcaattactatgcaaggtattaaggcatatattgacaagttttataaataaatgcacttaataaaatacatagaacgcatagaatttgaataagttttttctttgttagcttttctgccggcataactagtttcctttgcactttttaaatttaaaacttcttaattattttatttaatgttatcatttcttgagttagatcaagttttgcattacacgcttttatctcagtttcaatgcttttgaggaatgaatgaaaacttttccctatgaacaaaaaattggacgacgagttcaatctactggttgtgctattcactgtcaagcttgtagtattagtcaactatgtattccgtttatgtttaatgaacatgaattaaatcagcttgataatattattgagcgtaaaaaacctattcaaaaatctcaaattttatttaaagcaggcgatgaactgacttctctctatgctattcgatccggctccattaaaagttatactattggtgaaactggagaagaacaaatcaccgcctttcatttacctggtgatttagtaggatttgatgcgattaatggtatgcgacattttagttttgcacaagctttagaaacatctatggtgtgtgaaattccttttgatattcttgatgatctatcaggaaaaatgccgaaattacgacaacaaataatgcgtttgatgagtcatgaaatcaaaacagatcaagaaatgattttgttattatctaaaatgagtgctgaagaacgtctagcagctttcatccataacctttcaaatcgatactctgctcgtggtttttctgcacgagaatttcgtctaacaatgacccgtagtgatataggtaattatttgggattaactgttgaaacaatcagtcgtttgttgggacgttttcaaaaaaacggtcttttatccgtgcaaggaaaatatattactattaataatatgtcagaactttctacacttgcaggaacgacaaaacctaaaattaaaatgatcggataaaaacttggacgcaataataagttactactttcgatcattttttaaagtacaattacttgtcatttttataaatattgcctattctatttctatagtttgtttccactggaaaaatatgtttattgtttttgcaaaatatcggaggttattatgcaatttaataatatacttgtcgttttaaatcccgaatcagaaaagcaatatgctttggctcgagcagttcgtttggtacaagaacaaaagagcgagaatagagtaagaattacaacttttatgacggtgtatgatttttcttatgaaatgtcaactttgctttcttccaaagaaagagaaacaatgtgtaaaagcattattaagcaacatcagcaagctgttcaaccatatctcgaaaaatatgcggatccgaatattgaatttaattcaattgttctttggcacagtaatgaagcggaagctattacaaatgctgttgcggaacataattatgatcttgtcattaaatatactcaggagaaggaatctttatcggcattaatttttacacctcaagactggcaattactacgcaaatgtcctgcacctattatggtagtacgtgatggaaattggaaacatcaacgtcgaattttggtagcggttaatgtttccaataatcaagaggaatatacttcattaaataatgaacttgtttctttaggaattgatttagcggataaattagaacgaggtaatattcatcttgttaccgcttaccctcccactccaattaatatggcaattgatttacctgaatttacaacaacagaatatggtgatagtgttcgtggacagtatcttttaaatatgaaagcattacgccaacaattttgtatagatgaagaccatactcacgtaagagaaggatttcctgaagacgttattcctgctgtcgcaaaagagctggaggctgaattggttgttttgggaacagtaggaagaacaggactatctgccgcattcttaggaaatacagcagaacatgttattagcaaattagaatgtaacttgttggcaattaaaccgagtaaaaaataacaaaattattacacgaaaatcctaacttaatcgttaggatttttttaaagtaattttaaaaatgagcctacggtatagaatgagccaaatactaaaataatatccttttctgtggcattttgtaccgcactttttactccctcatatacagaagaataagtttgagcagatagctcattagttgttgatatttgttgtaatgtcataaataattcatgactactctgccctcttacgccatctaaggttactaaattccactgatcaacaactttgattaaaggcgataatattccttgactatctttatcttttagaataccacataccgaaataatttttccgattgatttagctttaagtgcggttaatctttctaataaataggaagctgcatgaggattatgaccaacatcaacaataatttgaggtaattgtttaactgtttttttacttaatttagctaaatttaataatttttctgggttgattttctgaaaacgccctgccagttcaacttctctaagtgatttatgaataactgatatagaaatatcaaaaggtaaataagccaacgttgctaaagctgttgcagcatttgccaagggaatactacaaataggtaaattatccatataaatagctttattaccttttattgtttcccatgtccagccattttcctgtttgctgaatttccaatctttattacgacaaaataatattgaatctaattttttcccttgttctaataaagaacagggaatattgttttcaccaataacggcaggcttatttggacgaaaaatacccgatttttcaaaagcgatctcttctcgagtattacccaagaaatccgtatgatcgatatcaatactggtaattacggcaagatttgcatcaacaatattagtagcgtccaaacgaccgcctaaccctacttctaaaataacaacatccaaattagcttgcttaaagagatacaaagcagaaagtgtactaaattcaaaataagttaaagattgtgatttatgttgttcaataaaagcaaatgcttgagtatgttcttcatcagctaattcttgattttgaattcttactctctcgttataacgaattaaatgaggagaggaataaacaccaacacgaaatcctgagtttagtaataatatttccagtagacgacatgtcgtcccttttccatttgttcctcccacagtaataacaaaaggagcaggctgtaataaatctaattgttgtgcaactgttttgaccctatctaatcctaagtcaattgctttagcatgtgctttttctaaaaaacaaagccactgttcaagtggcgatgttgcaaataaatttaaactagacatcatcagatttttcttgaattaattcaggttcaacaaaaggggatggcatattcatgagcttgcttaaaagattagctaaagtttcacgcatctcagaacgtttaacaatcatatcaatagctccatgctccagtaaaaattcactgcgttgaaaaccctctggtaatttttcacgcacagtctgttcaataacacgaggtccggcaaatccaattaatgctttgggctctgcaatattaatatcacccaacattgcaaaacttgcagacacaccgcctaaagtcggatctgttaatactgaaataaaaggaacacctttttctttcatctttgccaatactgcactggttttagccatttgcattaatgagaacaaagcctcttgcatacgagctccgccacttgccgaaaaacaaactaatggacaatgtaattctattgctttttcagcagcttgaacaaattttgagcctacaacagatcccatagaccctcccataaaactaaaattcaaggcagccacaacaattggcatgccataaagagtagctgaaacagtaatcaacgcatctttttcgcctgtttctttttgggcggctgacagtctgtctttatatttttttaaatctctaaattttaaaatatctttaggttctaaatctgcagcaatttcaacaatgctatctttatccaataaagcaacaaggcgttctcttgcatcaatacgcatatgatgaccgcactttggacaaacttctaaatgacgttttaattcatcacgatacaacacttgctcacaggaagtgcatttggtccataccccttcaggcacatttgattttttgctatttgaagttgtatttttactaaaaattctatcaatccagctcatgtttaaccttttatttattaacttaaaactcgcctcattagaccataagtcgggggaattttccagaatttaacaactccgactagcctattaattcaagcaatttaactgccattaacgctagattaaagtgttgctcatcggctacagaccaaaattctattttattttccgccgcacttaatgtactaatatgcaatttcactttttcctcattgttttcattttctccgtgagtaaccggcgtaattaatttctctgcatgatattgaattagctcattttcttgccaaaaatgtaattggctttctatatcaaccaaataatctgaaagtgcagtcacaaactaccccattccataaaatacaggcacttgaatttgatgaaagacaatattctctaattgtgggtaaattttttgtaactgtataactaaattttgagtttgtacaggaaagacatcaaaggctaaacgttgctgttccgtatccagcggaatcccatttaataattgtgctgtctgtccagccaatttggcaacttgttctgcttctacataggaagcgggtaataatgaagtcacaaccaattgatgaatgctattaacaatattactgatagctaaagcacattgcgttacttgtggatttggaagggaaacaatatttctttggcgtaattcaatcaattgatcgtcattaatacctggtacaacaacgggaatatttgcaaggcttgcacaaatgcccagtacatcgatcacaatacaacctgaatcagctatttttgccaaaagatcaacatgctcaattgtccctgcaaacaaaacataattaaactctgtccaatctgcctcttcaggcataatttgaataactgctttattgttaaaacgaatgccttgctcttctttgaaaggctttatttcaataattgtcaagctttcaatttcaagctgagtgtgttctaaagtttcgacaattttctcagataactcaaattctgctgcaatagcaatacttaacatttttctctcttataaactcggatagaatgcagtgcattttacaaaataattcagggaaaagaaaatgctcctgtaattatttactaggaatattgctcagaaaattaacgcaataaatcccaaacaggacgacaattttccggtaacactagagattttcccaattcaatccaactacttggaaaatgaaaatcggaaccaacggaactgtataaatcgtactcttccgcccaacgagcaagtaataaacgttgatccttggtttgtccacaacctgctacttctattgcgtccccaccccactgtttaaaatcagcgataagacgttttatcttttttgttgtcatggtatagcgtaatggatgagcaagcactgcaattccgttggcttgatgaataatctctattgcattagggatatcaacccattgtgttttgacatatgcagattttccttgtgctaagtattttttaaaagcttgactaatgttaataaccttgcctatttgcactaaataacgggcataatgtgctcttgttaattctccattcgtcagtttttgcgtttctgcaaaggcgttggctacacctaaatgctccaattttttaccgatttcaaccgctctttgtaaacgaatttttgcctgctcattcaaaagtgcggtcattttttttgaattttcatcaaaacctaatcctacaatatggatactataattttcccaagaagtagaaatttcaacaccattgatcaatgaaatacctaattgttctgcttgagtacgagcttgcgataatcctgcaatagtatcatgatctgtcaaggctaaaacatttacaccttgttgatgtgcccttatcactatctcttgtggtgataaggtaccgtctgatatagaactatggcaatgcaaatcataaattttgttcatactttcctaaattacttatcaaaaataaaaagtgcgataaattttaccgcactttcacttagttatgtgtctgttttcgctattgaagggctttttctattttctcaaacaaatctttcgacaaattttccacttcgcttaagcgaactaaagcacgtttcatcaaagtttgccgttgaggatcaaaacgagagaaacgaattagcggttcaattaagcgtgaagcaacttgaggattactttcatttaaccttaacaggatctcagttaaaaaacgataacctgaaccatcgattgcatgaaatccttttaaattatgtacacaaaaactaccgactaaagctcttaaacggttaggattattaaaattaaaacttggatgttccattaattgttgcacatagtccaaagtattgtcttcaggtcttgtagcttgtaaggcaaaccatttatccataaccaaaccgtcttgttgccatttttgctcaaaatccgctaataattggtctcgacaaggtagttgagcctgtgttgccgattttaaagcatttaaactgtcagtcatgttatttgctttgacataatgtttattcaccaaattgttacctaaatctgtataagccaaataattcaaacagagattacgcaatgctctcaacgcaatatcttgctcagttacttgatatgtctctaactgaatttcattataaattttcaagaataactctttcaaattattggcaatatggcgttgcataaattctcgcactgcataaataccgtccggatcgatcgttttgaataattcggcaaattcagtttcttttggcagtgttaaaatcgttgttactaaaccaatatcttgctggtaattttctaatacttgataaagtgcggtaagaatttcagcagaaaactccagtgccagtccttgttgataatgaattaagttacgtcgtaactctgcattaaataacatttgagccgcatcccaacggataaaatcatttccagcaaatttcaacagtatgattaattgttgtgtattataagcataatctaattttaccggtgcggaaaaatcacacaataacgctggtacaggacgtgtataaatgttttgaaattcaaaaacttgttctttttgtgtaagatttaatacatcagaaagatctttgccatcagcctgtaaaaattgctccacaccgctttcatcgtataaagcgatttttattggaatatgtaaattgactttttccatctgatcggcagttggcggggtaaattgtgagattttaagttgataaacgtgatttttttcgtcataaaaatctgttacaaccaattccggcgtacctgattgactataccaacgacggaattgggttagatcaagtttattggcttgttccattgcaaggataaaatcttcacaggtcgccgccttgccatcatggtctgcaatataacgttgcatacctgcctgaaaacctttttctcctaataaagtatgaagcatacggatcacttctgcacctttttcatatactgtaactgtatagaaattattcatttcaatcactttttccggacgaattggatgtgacatcgggcttgcatcttctgcaaattgtactgtacgtaaaaattttacattattaatgcgattgattgctcgtgaaccggtatctgatgagaactcttgatcacgaaatacagtcagcccctctttcaaacttaattggaaccaatctcgacaagttactctatttcctgtccagttgtggaaatattcatgtgcaattacactttcaatcgctaaataatcttcatccgtggcagtttgcggattagccaaaacaaatttagaattaaagatatttaatcctttattctccatggctcccatattgaagaaatcaaccgctacaatcatataaatatctaaatcgtattctaaattgaaacgtgcttcatcccacttcatggactttttcaatgcactcattgcccaatgagcacggtcaaggttaccccgatcaacatataattccagtgcgacattacgaccgctctttgttacaaaattatcctgtaataagtcaaaatcacctgcaactaaagcgaataagtaacttggtttagggaaaggatcttgccattcaacccagtgacgaccatctttcatttcaccacaagcaatacggttaccgttcgataaaagataaggatatttagttttatccgctgtaatttttgtggtatagcgagcaagcacatcgggacgatccaacatataagtgatttgatggaacccttccgcttcacattgcgtacaaataccctcaccggattgataaagcccttgcaaagatgtatttgcactagggtttagatgagtaacaatttctaattcaaaggtattggcatttacgttggttaaatccaacacgaggctttcagcatcttgttgataagatttaaactcttcatcattgagtttgactgaaacaaattgaaaactatgaccatcaagacgtaactgtttgctttcaggattaagacgttgaaattgacttattgctgttacgatggtttgttgcggatcaagttgaaaatcaagataaatatcagtaacagtaaaatcgggggattgataattctttctatatttggcttttttttgcataatgacaacctaaatttattgagaaaaactgtgctaggatatgatttttcgctaggtatttcaagttataacaattaagggagcgtttcgctcccttttgaagttttgttacgctaattttaatggctcaattttccatattttttctgcatattctaaaatagtgcggtcagatgagaagaaactcatattcacaatattttgcaatgcactttcaacccaagcttcttgatttttatatttttcatccactgctttttgcatctcaacatagctacgaaaatctgcaaaagattgataataatcgtaagaacgcaatgaatttaacaaatcatgatagcgagtaggttctttgggtgagaaacaaccagcattaatctgatcaataacttcacgtaattgttcatccgactgataaatatcaaatggatgataaccattacgccgtaactcttctacttgctctacggtattaccaaaaatgaagatattatcttttccaacattttccaatatctccacatttgcaccatctaatgtccctagcgttaacgcaccatttaaagcaaatttcatattgcttgtaccggaggcttctgttccggccagcgaaatttgttctgaaatatcagctgccggaataataatttgggcaagactgacactataatttggaataaacacaacttttaaacgaccttgtaagcgatcatcattattaatgatatttgccacatcattaattaggttgatagtttgttttgctgccgtataagctgaagctgctttaccggctaaaataaagacccgaggtgtccaatctttttctggattagcaatcatttcattgtaacgagcaacaatatgtaacacattaagaatttgacgtttgtactcatggatacgttttacttgaacatcaaatagagcgtttgaatttaattcaatacctaactcttgttttacataattcgctaaacgttgtttatttttacgtttaatctctagaattgcttttttcaattcaggatcttgaatatgtgctttaagcgtttctaattgagttaaatctttacgccattcagtgcctatatatttatcaaataatgcggataaatcaggattcgctaccgcaatccaacgacgaggggtgattccgttagtgacattggtgaaacgttcaggataaatgcgataaaaatctgcaaatgtagaacttaccattaaatccgaatgaattgctgctacaccatttactttatgcgatccaacaacagatagccaccccattctcactttacgtatattaccttcctcaatcaatgatatacgacgaataaagtcgttatcagtagtaacagaagtgcggacatattctaagaaataatcgttgatttcaaagataatctgtaaatgacgaggtaatatcttcgccatcatttctaccggccaagtttctagtgcttcagacattaatgtatgacaagtataagagaatatctgacagcacatatcccaagctttttgccaagtatatccttcttgatcaattaaaatatacatcaactctggaatagctaaagcaggatgagtgtcgtttaaatgaattgcaattttatccgctaaattatccaatgtattataaattcgcttatggcgtttaataatatcttgtagagaagctgaaactaaaaaatactcttggcgtaaacgtaattctctgcctgcagctgttgaatcatccggataaagtactcgagaaacattctcactagaagatttttcttcgatagcatggaaataatcaccacgattgaatgacactaaattaaaagtttcacctgcgtttgcactccataaacgtagtgtagctgcactgtcattgctatatcccggaatcatttgatcgtaagcaagtgcggtgatttcttctgcatttttccaaatacattttttcccttcaaaataaatatgccctccaaaacggatattaaagcgtttagacggacgaataaattcccaaggataacctttttctaaccacgcatcaggtttttcaacttgtttgccatcttcaatatattgctgaaacataccatattcataacgaataccatatcccataccaggtattgcaagcgttgcgatagagtccataaaacaagctgctagacgacctaatccaccattaccaagaccgggatcaacttctttctccaatacatcttctaaatcgacattaagttcagctaaagcatctttagctaagtgatatacgccttcagaaattaaggcattagataaagtacgccccatgagaaattccattgaaagataataaactcgccgagtttcttcttttcttgcttgatgggcagtggaaatccagccctctgttactaaatcacgtatggcgtataaagttgcatttagccaatcacgttgacttgcctcctccggagaacgaccaattaaaaaaattaatttatatacaatcgatttcttcaacgaatccttcgtattttccggacgattataagaaaaaggaaggggaagtgtatttaccattaggctcaaactcctgatttaataaaaaactaccgaattttattcatctgtataaaaaaaacaataaaattttataaaaaataatttgaatatttctactcaaattatttcgctaaaaaatttatttatgtaaaagaatatcatatagggattgatatccttttgcagatgtctgccaactgaaatcctgttccatagcattgactatcacactttcccattgacttggtttacgccacaaagtaaatgcactatcaataccataacataatcccccaacatcagcatcattaaatacaaatcctgttgcatgacgtgctttgatgttttcactgctactatcaatgacagtatcagccaaaccacctgttgaacgaactaacggtaaagttccatattttaatccgtataactgcgttaaaccacaaggctcaaaacgacttggaacaagaatgacatctcctccggcaatcattaaatgtgataatgcttcatcatatccaatttttactgcgatattttccggatactcttgtgcaagccaattaataccggcttctaaatgtgctgaaccggaacctaaaattgctaattgcccaccttgttgtacaattctctcggcactaccaattagtaaatctacacctttttgctctgttagacgtgtaaccattacaaataacagtgcattaggattttgtggtaaattaaaataagcttgtaattttattttattcttacgtttaccctgcattgatttcaatttgtaatgatcttcaatatacggatcactatacggatgccaaattttttcatctacgccattcaaaataccaaccaatcgtccctgtgctttcaaagtttgcaacaacccttgtaaaccataagcaaattcaggtgttgtaatttctttggcataggttggactaactgcagtagaaatatcggaataatacagtccggcttttaaataagacatttcaccatataattccaatccatctacattaaacatccaccaaggcaatccaatttcagttagatgataaggtaaaaaacgtccttgataggctaaattatggatagtaaacaccgatttagcagggcgtcctttatgatgcaaataagcagctgttaagcctgcatgccaatcatgagcatgcacaatttcagcacgccaccaaaagtctaatcctgtagccaactctgccccaacccaagccaataaagcaaaacgcttatagttgtccgtataatcgttataccacatatcatggtatggattaccttcacgggcatataaatgcggtgcatcgattaaataaacaccaataccattgtattcaccataacgtagtacaacatgtccggcaaaattatcaaattcagcaactacaacggtatttggaataccacgagaaatagcaggataagccggtaaaacaagtctagcatcaataccaatttcattttgtgcaaaaggtaaagcccccattacatcagccaatccgcctgtttttaataatggatataattcggaacaaacatgtaatactttcattgttaattttaatcctcccatcaaggcggtaaaaataaaaaattctaccgcacttatttatatttacacctagtctaaatgaatttcagagacaactttttcgccatttaattttttcatcattgattcagttaccaaaataacttttccggtactacttacacggaagcgtttgcgatcctcttcaatatttacaccaataactgtgttatccgggataactacttggcgatcaataatacaattacgtaaaatacaatttttaccgatagttacttgaggcaacaccactgaatattctactttagaatcagctttcactttcacttgatcaaataacacagaataactaatttctgcatcagtaatcacacaaccaccggaaataagcgaattatctaccggtttaatatcttgcttgttatagaagaattttgatggataagtttgggtcggattaccgcgaattggccagcgttggtcataaatatccaattgcggatgttcagatactaaatcaatatttgattgccaaaaactatctaacgtccccacatcacgccaataaatctccccatccgtattacgtcccatacaagatcggctaaacggatgcgcatataaaacttcttcctctaaagattttggcaaaatatctttaccaaagtcatgagaggtatacggtgtatttacttcacgcatcaatacatcatatagataatctgcatcaaacacataaattcccattgaagctaacgaagtatccggtttatttggaatcgccggtggatcttttggcttctcaacaaatgcttttactttcaaattttcatccactgccatcacaccaaactctgatgcttgttcacgtggaacttcaatacagcctacagtacattttgcattgcttgaaacatgatctaagagcatttggctataatcttgtttataaatatgatcaccggctaaaattaaaatatattttggacggtaatgatcacgaataattgccatattttgataaaccgcatcagctgtgccacgataccaagtagaatcatcaatttgctgacgtgccggtaacatatcaataaattcaccacgttcttgcggtagaaatgaccaccctttttgtaaatggcgtaataaagaatgagcagcatattgcgtgaccaccccaatgcgatttaagccggagttaatacaatttgataaagcaaaatcaataatacgacggttgccaccaaaatataaagctggtttagcacgtttatctgttaattcgtgaagtcgtgagcctcgacctccggcgagaattaatactaaggtatctttaacaagtttatgtttacttaaatttttagtaatactgttactcatagcaactccttatcttttatttttatactcacgactaactcacatttacttgagttattcactttttctgcaacacaccaaaagccaaatccgtcatctccaactgcttgttttctaaatgtactacttttgaataacacaaaatctcccaattgccttgaggtaataagaatttttgtgaacttgtttttgcgttgataacgaacaggtatttactgtccagcaaaatctgcagagctttgctctctttattatgccactcatctaatgacatcttctcagcatcaatatttaaccaagatacattgctctcctgccaccaattatcccgttgtaaactcggaatttgtttacgcaatgcaataacttgcttaaccaaattaaagagatcttgttcaaaatattgccattttaaccatgttgtttcattatcttggcaataggcattgttattaccgtactgcgtattaccaaactcatcaccagccaatagcattggcgttccgtttgataataacaagctcagtaacaacgcactacgacttaaataacgagcttcttcaacaagagaatttccctctttatatccttccataccatggttataactataattctcactccgcccatctcgattatcttcaccatttgcccaattatgcttttggttataacttactaaatcatgtaatgtaaaaccatcatgtgcggtaataaaattgacagaattatgtggtaatttcccctgacaacgatatatatcactcgaacctgcgaaacgctctgcaaaaacaccgagttcaccgcttttccataaccaaaaacgacacatatcatcacgaaatcggtcattccattcagcaaaatacgctgggaaattacctacttggtatccacccatacctatatcccaaggttcggcgataaatttaactttttgcaaaattgagacctgctcaatttctttaaataataaggcattagcattaaaatccggcgtttctcgtcctaaaactgaggctaaatcaaaacgaaagccatcaacatgacattcttctacccaatagcataaacaatcaattatccactttcgtcctagttcagtggataaattaagtgtatttccacaacctgttagattaatgtagtttcccgcttcgtcctgccaataataagtccgatcatcaattcctcgttgactaaacgttggaaaatgcttttccgattcaacagaatggttgaacactacatctaaaatcacctcaattcccgctttatgtaatgcttttaccattgatttaaactctgttaagggtgttgtatcggcttgatttgaccaatatttggactcaacagcaaacatcgctaagggactataaccccaataattctgtagtcttttctcctgcaagtgcggttcatctaaatgataatttattggcaataattccaccgcacttacacctaattctttcaaataggcaatgacattttgatgagctaaacctgcataagtccctcgaattgcttgcggaatgtcctctcgcaactgagtaaaaccttttacatgcaattcataaatgatactttctgaccaaggtgtttggggtaaaatatctccttcccaatcaaaagatgacgattcaattaacgctttaggtgctaaatgtgcgttatctctctcatcttcaagtaaaaaccaagctctattttctacacaacttaaatcaggtttacccacaacagctttcgcatagggatctaacatcaatttatttggattggataaagaaccgtctacaccatgaatacgaaaaccatattcagttccatattccaattcagctacccaaatatgccatatattttctgtacaatacattgaataacgggtttcttgaacagaatttttattaaaaatacaaagttcaaccgcacttgcctgtgaggaatagattgcaaaattaaatcctgcaataccttccatacaacattctgtacaacctaaaggatatggtttacctaaactcatcttactcataaatattcaaattgtttttatacctttagctaacgttgttttctactgatgtcgattctgcaatcacctctgcatttggaaaaacagcactttcctcgttttttacttttttaactaccgctctttttgttaccgtctttttaggcttaacctctgttgcctcagagacagtatcagcgacagtttttttggttctcgtggttttaccctttgctatttttttctctgttttcaccgctgtatcttcaactttcgaggtttttctcatttttctgactttttttactttatgcagtttaagatacactgttgctagaggagggatatcaatactgatagattgtgctttattatgactttcaatatcttcagttacaattttgctcgtatttgtcgaatttgatcccatatactgttgtgcatcggagtttaaaatttccatatattcaccggcaatatttacaccaaaacggtaattttgacgtaaaacaggggtgaaattactgataacaataatacgttcatcttttttactacgacgctcaaaaacaaacacggaattttgataatcatcaacaacaagccattcaaaaccttgtggatccgtatctaactcaaagagcggtgcatttttttgataaatatgattaagatctctaacataatcctgtacagctttatgccagccaccaccatgaaattcatcaagaagataccaatccaaactttcctgataattccattctctgccttgagcaaattcattgcccataaagagtaattttttacccggataaccccacatataaccataatatgcacgtaaattagcaaatttttgccacgcatctccgggcattttaccgagtaatgaacatttaccatgtacaacttcatcatgtgaaagcggtaaaataaagttctcactatattgatacaccataccaaaggtcatttggctatggtgatgttgacgataaatcggatcttttttcatatacgacaatgtatcgttcatccaacccatattccatttaaaatgaaaacctaaaccaccttcatacggaggatgagtaacaccggcaaaagaggttgattcttccgcaattgatacaacaccaggaatttccgttcccaataaatgattagtttgtttcaaaaattcaatggcctccaaattttcacgaccaccatactgatttggtatccattgcccgtcttcacggctatagtcacgataaatcatagacgcaaccgcatctactcgaataccgtctaatccaaatcgctccatccaatacaacgcattcgaagccaaataattttttacttcatgacgaccgtagttataaatcaaagtattccaatcttgatgataaccttctttgggatccgcatgttcatataaagccgtaccgtcaaaagcaactaaaccgtgcgtatcgcttgggaaatgacctggaacccagtctaaaatcacattgattccagccttatgagctttattcactaaacgtttaaaaccttcggctgtaccaaaacggctagtcggagaatataaaccaataggctgataaccccacgaaccgtcaaatggaaattcagacaggggtaaaagttcaatatgcgtaaatcccatgtcttttacataaggaataagctcctcagcaatttgatcataatccagccaaaaattattttccaagttacgacgccaagaacccaaatgtacttcataaattgaaatcggctgatcagcttgattagcttttcggcgtttttcagtcattgatacaatttcaggcaatgccccaatttgtgatgctgtatcaggacgtaattgtgaactgaaggcataaggatcggcttttaagcgtaattgattatgacagtctaacagctcaaatttatacagttgccccaacgatactttgggtaaaaataattcccaaataccgctagattgatgaaaacgcattgggtgccggcgaccgtcccaatagttaaaatcgcctacgaccgaaacacgtttagcgtttggtgcccacagacgaaaatttacacctgctacgttgtcacattcggtaaaatgtgcacctaaaatttcataagggcgtttatgggagccttctgccagtagccaattatcaagttcattaatcatcggatgaaatgcgtaaggatcttctataacttgagcttcatttccccaataaacttctaattgatacgcaaaaaaactatgcgtattaggcacaacaccggcaaaaaaaccacgttcatctaccctcgataattcacaaagtacattttttgtttctttactgagaacaaatactttttcagcatccggtaataatacccttacttcaatcccatttgacgtttcatgcatacctaacacggaaaaaggatctgcatgttttccatcaaaaaaagtatcaatggtagattgtgatacaaatttattcataaaaaccctgcctatttatttcttgcctgattaattgttctaattaatgaaagtactgttttatcagtaaaaattttttctagcggttgtaataatttcttacgccagttaggatattccgttgaagtaccgggtaagttaaaagaaacctcttgattaagtaaattttccagttgtatacctattaattgcgtttgactttcagctaaatattgatgaatgacatgatttaaattatcgtgcattgccatatttaacgcatctccccaataatcaggcggtaagtattgatctcggtgcaaagtattaagcaacgcttgtttatctactactcgctgatcatattttgattttaaaacatcttctttcaacatacctaattgagcaaacagttctaaatcacgacagtgccaaaaactctgcaatgaaggaagatcatgagttccaactgtagcaaatgcttgcaaaggaaaatgatctgctttcggatattcgttgtgttgttgctcaaaatacagaacaaaataagagaacactttaaattcatccaatttaaaccgcacttcattaggtacagtacctaaatcctcaccgacaattaaacattgattacgctgactttcaattgccaaaattgccatcaactctgcaaaaggataatgtacataaagtccatcacaggcactttttccttccggtattaaccacaaacgaaacaatcccataatatgatcaatacgtaacacaccaaaatgctgcatattggctcgcaacatatcaataaaaggctgaaagccacgagcttttaaaattgttggattataaggcggaatattccaattttgtcctaccggacccaaaggatccggcggagcaccaactgaagcgttcacacaataaagtgtttgatcggaccaaacatccgcacttcctctcgaactgcttacagccaagtctccataaattcccaacgatagacctttttccaagcacaagttttttacttcagttaattggatagtagccaaccactgcacccaagtgtaaaaatccacttgtgttttatatttacgtaacaaatttttgcgttctttatcagttaaaatttgccattctttacgccaacctaaccaaccaattttattttcatcttccggcatattttgatgttcaatactatctaatacgtcaaataaagcctgagataataaagcatcaccttgtgccttcacaaactcagcaaattggcgacgacgctcaataattttacttgctctgctacgcttaaaataagcgaataactcttctaatgcagaacgttttaatgacattactgcctgataatctacgatatcagattggcacaactcagtcagtttagcttgagtattctcttgtttaaaccaattttggactttttgacataaattaaattcaggtaatttatctactgccaaatataaaaaattcaaccaacgtcttgaagaagaactgtaaggacttgcccattcaggaatagccggataaagttgatgtaacggattaattccaataaagtcagctcccagcaccgcacttttctcaattaaatatgcaagatcggcaaaatcgccaatcccccaattgcgtgcggaaaccaaactataaagctgaacattaattccccatgcttttttacgttgaaatactgtcggttgataagattgttgaggcgaaactaaaatgcgaacgacatagttctttccatttatttcaagaagcaacgaataataaccataagctaaaggagataatgttagttttttctgctctttaagaagttggctccgagacaggaagttcccattatcatcatacaaagaatattgaatagaaatgccggaagataaattaaatgcggttaagtcataaattataggttcattttcactgacgactattacatcatcaaattttttatcttctgaaccgacttccgtttgactcagtaattgaatgaaataatgcagactttccggttttgcgtaaatcaaattaccatcaatatcataatgagatatggcaatccctattttttctgcatcttgttgtaattgattagaaatgcccatcttactctcaaaaagcttaaaaagaattaaatcaatttcattctatctaatcttaactgataaaagcaaacgcattactttaaattgtgatccagttcaaatagaaattttaagttttttcatcaatcacaaattcaaaccaatcaatcacatctttttcatgaataccctgctcaatcatcacaccagcacgtttcatcgcttgagaatgaccaacgatgagaggatgccaatcaaagagcggtttattttcataaagtaaacgataagcacaagtactgggcaaccaactgaaatgtggcaaatttgctttagttaattttgtacaatctttctctaagcgaaaacgtttctcataatgaccgcactttcccgtttctaaattcaatagattgcaagcaatacgagtaaaatacagcttttgtcgttttcctcgcccttcaataaacttacggtaacagcacttgccacaaccatcacaaagtgcttcccattcttcatcgttcatttcaagcaaagatttatatttccagaattcaggggataaagtcatttcgaaaaaaaccgatactatcatcttaaaaaaataatccggttaaatattattcaaccggactcgtagaatattacccaattcagggaatgcggaatttaaccgcacttttattactgtgtcaatattgcttcaaatctaaattgagatggcaaaattttatgggctaaagcctctatattttgttgagttacttgctgtaataactgttgctcagcaaacataagcaaaggaccatcactcaaagaataactttgttccaattgagataaaatggctaacaatgattccttcgcctgttttaactgagattgtttttcactcacttttttagccaacaattcaggctcaatgccttgtttaagtatttgatctaatacatgatgagtcatctgcgttaattcctgtacacgcataggatcacaactaaactctattttcccctcaatttgaggtgaaaaatgttcttgttcaaaccacgcatgcactgcatagatacccgatgcctgttctcttaaactcaaccgtaatttctcttgtatgatatccgctaaaatatccagtaaatatttgttttccacttgccattgatgatcagctgcgaaatacatttcaacttctgctcttggctcatgcaagcctttaacaactaaacgctgctcgggtacatgtgcctttatcggctgtaatactctattttgtgttttaaccggtacattggctaaatatttttcagccaaattttgtaccgcactttcgctaatatcaccaacaataaaataagtgaaatctgttttatccgtaatatattgctgataaattgcggaaagtttatctgccgttaaatgcagattactgaaacgatttgcaccatatagcgtttcttgttgtggaaaacgcaattgctctactttctgcataaacgtcttttccggacttttttcattcacttcatcctgtaaagtttggcgatattcggctaagactttctctgaaacagggctggtttgtagttttaacctaaataatcgcagaatatccgctaaactttctgttttacctgccgccgtaaaaccctgatcagcctcatcaataaccgtcgtaaaagctatcggagcgtgactgaaatactgatcaatatcagcctgaggtacaatgccaattccagtatcatcgaccacagaaatcgccgctcttaacgcatgataatgtgatcttggcacagaacgtaatcctcctgctgtcaaggctttaaaataaacttgttgcggacttttatcactatacatataaatcaatttactgccgttacttaacaaatattcagtaattttttgtccacgccatactttttgcttagtggcattgcccgcaactaaatctaaatgcggaagctgaactaccctattatcttgttgttgccaagaagattgcgattgctgtaaagcctgttgccatttttgtgccaaccattgaatatcaaacgataatttgtgcggttttggctgagtaatcagcaccaacttggactttaactgcaacatttgttgaaaagtgcggttaatatctgccaaagtgagttgattgaacaattgatgatttaattcatattgatctttcggagaaagtagcacttgatcatttgccatggtaacaactaattcatcagcaattttgatactactcacttccaaatgtcgttgtttagtatttattttacgcaaacgctgaagttcatcatccaattccgtctgcgtaaacccgttttgagcaatttccgcaataaagttaaagagttgctctgtcgctttttgataatcctcattctcaagttgtaaagaaaatgtggattgtaacgtttgcttacctaaataatcatgataaaaattagcagattttacgaccgcacttgaagactgctgtaaatatgtttcccattgttgcaaacgtaaattaagcaaacgtaccacaatttgttgccataaattctctcggtattgtgctaccgtattgatattttccgccggtttaaaaaaactcaagtccaatcccggttcacgcatttctttctcagacacggtcgctaaacgccatttaggcggtaaaggaatatcaaaatcaatctcgggtaaaggttggtgttgtagcggatggctactccctaatttctgttgaattaaagacttaatttttactggattcacatcgcctaccacaataagactgacattatccggacgataccattttcgataaaaatcttttacacgctgtgccgaaacatgtttaatgacgttgacatcaccaatcggatctcgttctacataacgtgaccccgccatttctatttggctttttttatcccctaaacgcaacatagggcttaagcgtgaacgccattcttccaacacaattccacgttccgcctctaaatccgctggtaaaatggtaagatggtttagccattgatcaataacattgaatgccaagctaagagattgcagatcatttttagcgatatttaatgtataaaccgtattttcaaaatcggtaaacgcattaatatcacgtgcaaacttcattcctaatttctcaagtgcattaataatttgattttgcggatattgttgcgagccattaaatgccatatgttcaacaatatgggcaacccctttttgatcatcctcttcgtgcattgaaccggcattaactaccaaacgcatatacacacgattttgcggaaaatgattaggtaaaatgacataacgcaagccattttccagttgtccttggtgggcttgcgaatgaaaaggtaacgtatctttttcatgaaataaggattggcaagcgccaatccccaaaagagcggttaaaattagcaatattttttttaacattagaattcataccctaattcaagccaaaattcacgacctgctgcgtaaaaaccataatcctctttagaacttaacccctttctcgtttgattaaggacattcaatatatcaaatttcacaatcgcagaatgtttgccaaagattttaggttgccaacgaaggctggtatcccattgtgtatgagtgccgtaattgtaactgcgataaatcggtaactgactacttccacgacctgtgtccaattgattaaccccttttataggtgcttttacataaattcggttggtccattccaaattataatttggcatagacatatccacgccaatccgagccatccattcttcacgattgttattaactttagaccgcatttctaattcggtcatttgttttccgtctaaaatcacaatggaattcgggtcatatcctacacctatatcaatacctttggtatttaaccaatcaaaccctagcgaagctcgccattctgtctgccaaaatttccaactgtctttattttgaatttgcaacgtatatacattattgctgtaatctttgcctcgtgcaaaatgacgcacttttttacccgatggaccatcttcttttagtatgatgcggtttttattttgacgatgaatatatcgggcatcaaggataacattcccgagttcttgattaattccgaaacttagctcatcgctaaagggcgttttcatggaggcaacggactgataacgtgtcgttcccttactaccatctatatcatctaatttgaaaattccttcacttaatttcatggaggcaaaagagcggccataataacggtttgctccgaggcttaatttggtttgttcaaagggttgatagcgggcgacaaaacgaggggcaatattggtatttttcaggaaagtatcacgctctaaacgtaatcccggacgaacttcccatttaccccccagcttgattaaatcttcgacataaagggcgatattgtgataatcggtttttactgttcctttggaaacggaatttgaagaaagaggactttccatactatcctgcatgaaaatttcagatttagcattttgatcacgttgaaaacgatagtgcgtaaattgccagataccccctaaggaaatagaatgttcagtacgtccccaagtcaacggatccatagcaaattcactggaaaaatgcacattgcgttgcgttaaagcactatctcccattcctccacgttcataattaatcggatcatagttttcatcaaatgccaatatttgcttcaaataattagaggcggatttacgcttatctgcaaattgatcatacgccaatgtattagttaacacaccgctctttaacgaacgaatccaagctaaagtggcaccataggcttgatgataatcttgcacattgctatcaacatttgtatcaaagaatttagtttccacataattagaataacgcaaactcaattcaaagcgattatcctcattagcaagccagttaaaattcaacaacgcattatcggaacggcgtttatgtctgcgattatccgaactcaacttgtcatcttttcccagcactaaacgacgttgctgaatatctgaagtacggcgactaaatcctgctaccataccgatattttcccctaaagaatgttgtgcagaaaggctgaagaaatctttgctatatttaggttgaaaatccgcactactaccgttaggcgaggcttgtttaaatttttcccgatctttttcctcaagatgaaacttcgcccaattagaatggctggtacgataacgcagttgcacaccatcggtaccatcgtattgcttggttttggcgactacggcaccgccggcaaaaccgcctaaactggcggaaatatcgctgtcgtaaacggttacggaagacaataaattcgcatcaaagaaataggcttgtgcatgacttgccataggcaaagtttgcatcgctccatcaaaaatagccgagtcaaagcctaaatcattattgatattgacattatctacaaaataactggtttgattggcttccgcaccattaatcgaaatgtcagcaggtttaatttcacctcgttgaaaactgttttcatcactacgttcaaaacgcacatgagaattggttttcaaaaaatcagaaatattgccgttggaattaggggaagatttaatatctttggcggttactttttggctggaagataatcctgcgttttgctctgcataaacaacaacctccggtaattgattagctcgttcaactttatttttacttgtttctgcttgagcggaaaacgctaaacagacgctgacagctaataaggtttttttagtttttaaatcataagctgacataacttttccttaattagatataaatgataataattcttataaattttatcatctaaattttttaatgtaaaaatgttcatcgcttgcagaaaaaaaataatccgaccataggtatgatcggattatgtgagaggcattaaaatcattaaatatactcagtaatacaaccgcacttttggcggaaaggaactgatattaaaacccttctttcagactgacagttagattaaaaactaagttatccgcattactgtctttgctatcggcacaataatacccttcccgttcaaattgatacgcttgttcagctttggcattagcaaggctttgttcgactactccacgcttaatgattaaggaatttggatttaacacttcattaatgtcttccactgctcccggattcgctacggtaaacaatttgtcatacaaacgaaattctgccgataaattatccgttgctgacacccattgaataacacctttgactttgcgtccctcaggatttttacctaatgtttcgggatcataagtacaatatactgtggttacacaaccttccgcatctttttcaacacgttccgctttaatcacgtaagcattacgcaaccgcacttctttacccaacaccagacgcttatattgtttattcgcttcttcacggaaatcagcctgatcgatataaatttctttggtaaaagggagttccctcgttcccaattcttcacgatttgggtgattaggtgcggtaagtatttctttcccatcaaaattttcaatcacaatttttagcgggtttaacactgccattgcacgaggtgcgtttgtgtttaaatcatcacgaatacagctttctaatgcactgtattccaccacgttatcctgtttagttacccctatacgacgacaaaactcacgcaatgatgcaggggtataacctcgacgacgtaaaccggaaatggtaggcatacgtggatcattccaaccgtcaacaatcccatcattaaccaatttcagtagcttacgtttagatgtcaacgtatattctaaattcaaacgtgaaaattcatattgatgcggtaatggacgctcaatcgaaatattatccaatacccaatcatataaacggcggttatcttgaaattctagcgtacataatgaatgagtaattctttcaatggcatcggaaatgcaatgggtaaaatcgtacatcgggtaaatgcaccatttatcacctgtttgatgatgacttgcaaatttgatgcgatatagcacaggatcacgcataaccataaaaggagatgccatatcaattttcgctcttaaacttgccgcaccttctgcaaactcgccttttttcattttttcaaataacgccaagttttcttctacactgcgatcacgataaggactgtttttacctgctgatgtaagtgttcctctatactcacgaatttgctcgggtgaaagttcatcaacataagccaaccctttttgaattaattcaattgcataactatacagttgatcgaaatagtcggaagcatagcgaggccccccctcccattcaaaacctaaccattttacatcttgcttaatactgtcaacgtattccacatcttcttttaccggattggtgtcgtcaaaacgtaaattacatttcccctgataatcttgtgcaataccgaaatttaagcagatcgatttcgcatgaccgatatgtaaatagccgttcggctcagggggaaaacgagtataaacattatgatgttttccactagctaaatcttcatcaataatttggcgaataaaatttgttggtttatgttccgtattttccatttcaactgttatttcgctcattttttgtcctcaatgcaatttgataattaaaaatctgcgtattttacagtgttttgcacagaatacaaagcatagcggattttatctcacttggcatatctgtacattaccttttgtaaactttcaggtaaaatagcataacttctaatacaggtatttttataccgcacttatttttcatgaaaaggaacgtttatgtctgatttgaccctacacagccgacatacctatttagatcaagtcaaacacattgtggcaatcggtgggggtcatgggttaggacgtgtcatgtctgcattgagctttatgaatgagcgtcttaccggtattgttactacaacagataatggcggctcaacagggcggattcgacaaactcagggcggcattgcttggggtgatttacgcaattgccttaatcagatcattacagaacctagtacagcatctgctttatttgaatatcgtttttccggtcaaggtgaattagcagggcataatttaggtaatttaatgctgaaagcactggaaaatatgaatatccgtccaacagatgcggttaatttaattcgagatcttctcaaagtgcggtcttttattgtgccaatgtctgaaagccctgtacaccttgccgcctccttgtctcccggtaaaagtatcgttggagaagtaagtattgatcaattaaccgaaatccctacatctatttttttagttccattagtacaggcaaccactgaagcaattcaagccttaaaacaagcggaagtcattttattcggtccaggtagcttcttaaccagcattatgccgccattattactaccagaaattattgaggtgctgaaaaatagtcaagctaagaaaatccttattgataatttaggtgtagaacacggtcctgccgccaaattatctttaatcgatcgcattcaatggattaatcaaactattggttgtgatattattgatggtgcgatcgttcaaagcaagccgcaacagaattatcacgcctcctcaataaaaatcatggctcgccaacttaaagccgatgatataggctaccgccacgaccgcactttactttgtaatgcgattgacgaattattgatagaattagctcatcatttttcacctaagcaagtttgactaatttagctggaattccttgtctaacagcggagccacatacccaatcaacccaaggcgaggcaatctctttggtattatctaacaaaccaagatcattaatattaactccggaaccaatctgagcatgtccttcaattaatttcccattaattgtataacctgtggcccccagttgtttatgtccataaccatgttcaatcgcaattgtccctttaatgacaccgttcatcacaaccagctgcacaacagcttttcctcctggggtatttagctccacaagctcaccatgatgtaatccatattccgtagcatcctgttgattaattgccacaataccattaggtttaatactatgtaatcttagcaaaggtgctgtaatactactcattaaatttgatttaaaggaaattaatttaaatggccattgtattttagggtaatggctttcaactgtgctattatcggcaaactgatcttcaaaatacgttggacagccgtgataatttttaccggtttgagcatgtttggcttttgctacattttcattccaaatttgcaaacagtttttccagcgagcctgcatattatcttcctgccatgcactgctatgaggagcaaaacgtccgcctttacagtaaattgtagccactttcttaatttcttcaggttttaacacttgttgtaaacttggcatcaaacgttgtacacctgttagcaataaatcttcttgagttgcatcttgtaccggctgttttccatcataagctatattggcagctgctcgtaaaaagaagtcttcactacgatttaaaggataggaatgattttgtttatctaagatagcattatcaccaaatccaggtaattgcatcatcttagcaatttcgataacaaaactttccatacaaatagtatcgccttgagatgttttctcattaggcgatgctatcacaggccagcgggcagtactggtttttgttggaacaccagcccaaggggtactaaatccccaactctcaaaattatgggtatccggcacaatataatcggcaagggcggtagtttcattcataaaagcatcaatagaaataaagagcggtaagattttcggatcttttaatttctgttgcgtaatatggtgaatacctgtcataccataaattggattccccatatgattaatccaagctttaagtgagtatggatagccttgtaaggcagaggtaatcatttctgacatttgcccgccaacaaaaggataccaagcggctttcgctggatatggagaaataccttgtgctactttttgtttaaattcactggatttttcataatcttttttactacgagctaaatttgttcctttgggtttaaccatattggggaaatttgcaagattgtaacgaggtccggcagaaaaatctttaaatttaccgccactcatactcatccccccttttttattcatatttcctatcatggcattaagtaacaatatcgcccatgctgtatagaaaccattgctatgcatagttccaccgtgggtaataactgccgcacgaggtccgtgagaagtaaactttttagcaagttgaataatagtatcaacaggtacaccacactgctcagaatattcctcgatggagtatgaaaaacaagattctttgaataattgtaaagctgatttagctaaaacctgtgagccgtctttaaggcttatcctgtcttccacaaaaagcaccgcactttggcaatctttggcagctataaatttgcctgtttgtcgatctttcaccaaaatatcactatcgctcaatttttcaggttcgggtaaatcctctatatgaaaatttctaatggcttgcccatactgcttatgatttggatcggcgataaataaatgtgttgcattacaaaaacttacgccattagcttgttgcatcgcaatttcacttggtatagacaaataatcttcgttataacgttcattttcaataatccaacgtaacatggctagtgctaaagaaagatctttacccggaataattggtacccagcgatttttatcttgtgctgcagttgaggtaagctctaaacgaggtgctatcacgacatattcaaaattatcctctgtacgcttcttagcaagctgacgagattgacgtttaaatggatttccggattgtgcaggagaagttcccataaacaaaataaattcaacatgatcccaatcaggtttagcatgagaattattagcaaagtcattcataaatgcaccggatccggcacgataggataaaccacaaaaagagccatgagaggcgaagttaatggtaccaaaactgttgtttgcaaaacgtttcagaagaggttgtcttccttcaggacctgcgaaggttaccatcagttgatttacttttgcaccaaaatcagggtgttgtgcattcactggcgtttgcaaatcacgaatcgcttttaatccatctacatgcccctctccaaatagatctccgccattcacaacttcatcaattaattgctcaaaactgatcgttttccatttaccttctccccttttacctactcgcttaagaggttgtgtaatacgataagggctatttatcccatctaaaaatgcagctccacggacacaagcagtagaacgttgctgtaagccattttcaccagaaacgcttaactctgcttgtttaattgattgattataatcaaggtaatgatctgatgagagcgggtgataaggattaccgttaatacgcaatactttatttttttctaaatctattcgaacccgtaaaccacatagagtccagcaccccatacattgggtattacatactacttgttggctattggttaataaattgccctctttgacttgatattcaggtaataaagaatttccatttatattgtcttgtgttttttgtcctgaagaaccttcaattacgccctttgcaatttcttttactttgggagaataacctgcaacaaaagcagtagcggcagttgtagccaaagctccttttatcaaattacgtctttgtttattcatgatcttttctccccaaatttgattgcaatagtgtatgagatagcagttgccataaaataatacctactaatgaccacaagctaaagacagctatcattccaattagcccatctacgttccaactcaattgatatggatttaccaaagcgttatattttgcgatttgctgtacttcaattaataaaatccaacgggtaagccaagtgatacaaagtgcggttaatattcgtaataaccttaggaaagttgaatgaggcaataacagcaatatgaacaaaacgaagatcccgatgagtaataacatcggtgaatagctaatttgccataatttcattaaatgaatagctgtttgctcagaaaatagataaagccctaaaatagaaaccgttaaccctaataaactggcgatagtaaagtatctgagagcataaacttgaggtataaaataatgacaaaataataagctgacgggtaaaacactaaatacgagcaaaggtaaaagccaagtgtgatgccataaaggacgagcctgtacagtgaagacctccatcgtggtatacattaaaatcaatattgtcataattaaagaaagccaaacaaaaaagactttaattaaatcagtattgaatttcccccaataaagccagtgaaaatacttaggaatagattgcattggaactgaggtacgtaatgaacataaaaaatatcctgccacggataaaacaaagaaaggtaaaaaccatgctccccaatacatccaagaccatatcgttgggttcaaataaaaattcataatacgacccggttgatgtaaatccgcagttaaggcaataggtgcaacaattgcacaactgaacgctaagctaagagcaagcaattcaagacgtgaatttttaataaaatgaaagaagaacgcagtcaaaacagatgaacaggctaatccaataaagaaaaaatagcttaccgcccaaggtagccaagcaatagcttgtggttctactaagatctcacgaataatcattctgctttctccttatcttgccataacattggttgaccgttaacttcattcacaaaagcatcatctaaacctagataaaatacatgtggaatggtaccgtgatccggttttaaaaccttcaaatcatctttaaattcatctaccattttactaattgtactggttggatcccgtaaatccccaataatacgagctcctcccacacaactctctacacaggcaggtaataatcctgcttctaaacgatgagtacaaaaagtacatttatctgcagttttagtttctgaattgataaaacgagcatcataaggacaagcttgtacacaataagcacaaccaatacagcgtttgttatcaatcacaacaataccgtctttacgctgataagttgcttgtacagggcaaaccggcacacaaggagggttatcacaatggttgcataatcgaggaagtagaacattattggtaatattctgttcattggtgacttcatattgacgtacggtagtgcgaaactcgccaagtggtgtttgattttccaccgaacaactcaccgtacaagattggcaaccgatacaacggcgtaaatcaactaacatggcatagcgatgagcttcattaccctcttttctttccggctgaaaacttgtattcgcttgagaaaaagggataaaagcctgcccaatagttagtactgataagtttttcaaaaaacgtcttttgcttatgtacataatcactcctacctctaataaagattgagcattcaagttgatcaattcaggttgtctgaatatcaatgcctagtcttcccactcacaaataaaatatttaataaaattgagttgttacctcttttagcgtattgttaaaaaatctccatgaaaaaaccattgtggttttccacataaaaatatgaggatattgatcttcatcaataaaaggaaataaagtgagaaagtgcggtcagtttttaaaaaattttatgttaataatggctttattgccccagttagcttttgcacaatcttggaaaatcggtattttggcacagcgaggaattactgaagcacatgagcgttggcaaccttggattgattggctaaatcaacaatttgatgaacataaccaattttcattagttactctcgatcttaatgatctagagacagaacaagcacaaggagttgactttattttaagtaaccaatcccaatttttttatttaaataataaggaagttcgttggttggtaacattaaaatcgctaagacaaaaacaacatgacagcacaggaagagttggtagtgctatttttgttcgtagtgaaagtaatttttatcaattgaaagatttgaagaataaacgtataagtgcggtaggaaataaagcatttggcggatttttattaggttataacgaattatataaccaaggcttgatggaaaataaagatttcaagccggtttttacgggatttccggtagacaatacactattttttttaaaagagaaacaggtagatgcggcaattgttcccgtttgtatttttgagcaattggtaaaagagggaaaaataaaggctgaaaatttccgtctattggcagaaaaacctaaccacattggttgtctggcgagtacagtcttactacccaattggtcattagctgcaatgccacaagtacccggtgacttggcatcaaaattaataaccctattgcttaatcaagcgtctgataatcttccgcaatggacacctccatattcaacaaatcaagcggataatatactgcatcagctatataaacacccgaaacaaaatttatggcaagcaataaaatattggttctcacaatatcaattttggattactggtattattctgcttttattcgttaattatatttggataaattggcagatacatagaaaaagtaaagccttacaacaagcgtatcaacaacatcaaaaatatgaacaacagttgatacaggctgatagactttctattcttggagaaatgagtgcaggtattgctcatgaaattaatcaacctcttactgctattagaatgtatgtggaaggtatgaaatatcaagcagaagaacaaagaactcaaatcatattggataaaatattacaacaagtagatagaagtgcggagattattcataacttaatgaattgggtaaaaggaaaaagtagcgaagatattgagttaatcaatctcaaacatttactaaaaaaagtgactcaattcatttctctacaacattataataaatttcaaattaatctagtttgtgcaacagatatttatttggaaataaaaaccacaattttagaacaaattatctgtaactgtttattaaatgccttacaagcaaaagcatcaatgatagatattatagtagagaaagagcaaaaagaactaaaaataagaattttggataacggaacaggttttcaacaaatagagttggattttccttttgttcctttccgcacaagtaaaaaacaaggattgggcttgggattagtattgtgtcaacgtctaatccaagcgatgaacggtaatataaagctatcaaatagacaggatcaatctggggcagaagtgaccttaatcttacaaataaaaggaaaatagtatgaatattcatctacttgatgatgacttaacaatacttgatgccgctagttttttattggagcaagcaggttatcaagttaaaacttggtctaatagtcagcaatttgtacaacaagctaatatttttgaacctggaattttgttattggatatgaaaatgcctcatttagatggaaaagctgttcatcaatttttacagcaacaaaatagcccttttgctgtaattattatgacaggtcatggcgatatccaaatggcagtacaagaattcaaattaggtgcagtagattttttacaaaaacctatgcaatttagccaattacaatcagccattaaactggcgagaaaaaaaacaatggagaattatgaacaatatcaaatcaaacgatgttataagcaacttagcactaaagaattagaagttttatctttattattaaaaggttatattaatcgacaaattgcagaaactctaaatatatccgtcagaacagttgaagtacatcgttcacatattatggaaaaaatgcaagcacaaacagtggcggaattaatctacaagatcactcttattaaaaaggacgaataatattcgccctaccgatctggtttactcaatttataccttcatttgcagtctaattgcatcagcaaccaattagcttttgcacctaacgcttttaactgattttattcaacactttcacattatcaaaccctttctctcgaagatatagagcctgtaacttactcatcacccctcgttcacaataaagaacataatttttactttgatctaattcagcgaaatgtgaagataatttataaaaaggcattaaaataatattctgtcctgagatttccagcggtttatcatcgacttcctccggactgcgaatatctaaaatcacgtcattagccgataaaaccgttatttcatcaacttcaaatacttctttttttgtttgttcggcaatttgacgaatatctaaatattgtgcatttttcaccgcactttccagcacggaaaaatcaaaataactttcttcctgttcgattttttcttttacagcttttactgtcggacttttagaaatgacaccgcaaaattcaggcatagatttagcaatgtcctctgtaccaatttcttttgccttagcaataatttgttctttgtcatgcgtaattaacgggcgtaaaactaaactttcagccacctcatcaattaagcgtaaattagttaatgtttgactcgacacttgtcccagtgcttcccccgttacaatcgcttgaatgccgaaacgttgtgcaactttacttgccgcacgcaccatcatacgttttaacacaacacccatttgtccgttatctactttttctaaaatttccgcaacaacctgttcaaaattaatagcaacaaatcgcactttatgcgaaccgctaaaacgcttccaaatatgatacgccatttgtttcacgccaatttcatgagttgctccgcctaaattgaaaaagcaataatgtactctcgagccacgacgaattaacatgtagctggatacaccggaatcaaatccaccggaaataagcgataaaacatcttcttgtgtaccgataggataaccaccaatcccctgatgacgagctttaatcaacatcattttgtcattttcaatatcaattctgacggtaacatccggtttgctcaactgcacttttgcacttgcaacggcttgatttaaacctccgccaatataacgttcagcatccaatgaactaaaatcatgttttcctttgcgttttactcgtacacaaaatgttttattctcaatctgagttgctacatcactcaaagtttgctcaaaaatatcgtgcaatgtgacaaaaggtttttcttccacttctaagaaatgatgtattccgggaatacgtccgagtaattcaaccaatagtatccggttttctatattcttcgaccgcacttcgatgtaatcccaatgtttaactactgcaacagtatcatcatatttatttaatacattgcgaatattaccagttagaattttcacgaaacgtttacgtacgctttcgcttttaatcataatttcaggaaaaagtttaataataaatttcataatgagtttacatagctttaatttgatgattttcagcacacgtttcgcatactgaattgccttaagtttcgtgacatattagcattcatgccaaatgatataaattaatttttcatttgctatataattttattcataaaatacagtacaatagacaccctgatttaagatgaagcaaggatgattaatatggcacagacacttgacaaaaatgcaactgatgaactcaactttgaaacaaccctcgctcaacttgagtctgttgttcatgtactggaaaatggcgatcttgctcttgaagacgcattgaaagagtttgagcggggtattcaattggctcaagccggtcaacagcgtttgcaacaagctgaacaacgcattcaaattttattgcaaaaaagtgaaaatgcagaattaagcgattatcaaccaagtgaataaaatagttagtttctaatgtatcaatttgctcaagatctccaagaatccaaacaacgaattaatttttttttagaaaaacaattcgagtgcattgatagttctccatctcctttagctgaggcgatgaaatatggattattgttaggtggaaaacgtattcgcccctttttagtttatgcaacaggaaaaatgctcggagcgaatttaattcatttagattatgcagcagcggctattgaagctattcatgcttactcactcattcatgatgatcttccggctatggataatgattcactccgtcgtggacacccaacttgccatattgcctttgatcatgctaccgctattcttgccggcgatgctttacaaccttttgcttttgagctgttaactcaaacacccgatttgtctgccgaacaaaaattagctttagttcaaactttagccaatgcttccggtgttaaaggtatgtgtttagggcaaagtttagatttaatctcagagaatcaacaaattaatttatccgcacttgaaaagatacatcgcaataaaacaggagccttgttgtcagctgcagtgaagatggggtttatttgttctccgcactttgcaaatataaaattagaagaacaattaatgcactactcctctgctgtgggtttagcttttcaggtacaagatgatattttagatattgaaggtgaaagtatagtgattggaaaaactgccggatctgatctccttgccgataaaagtacttatccaaaacttataggtttagatggtgcaaaacagaaggcacaagaactttatcatcaagcactacaagaattggatgctttgccttttgacacttcagcattacatgcactcgctgagtttgtcgtaaatcgacaaagctaagtgcggttaaaataaaaatggaataacgaataatgaataaatatccacttctctctctaattaattcacctgatgatctgcgattattaagtaaagacaaattaccgcaactttgtcaagagttacgtagttatttattagaaagtgtaagccaaagcagtgggcatctagcctcaggtcttggcacagttgaattaactgtagctttacattatgtattcaaaacacctttcgatcagttactttgggatgtagggcatcaagcctatccacacaaaatccttaccggccgtcgagataaaatgtcaaccattcgtcaaaaaggcggattacatccatttccttggcgtgaagaaagtgaatttgatgtgttaagtgttggacattcatccacatctatcagtgcaggtctcggcattgcgattgctgcacagaaagaaaatctcggacgtaaaacaatttgtgtaatcggtgatggtgcaattactgcaggtatggcatttgaagcattaaatcatgcaggctccgtacatacagatatgttagttattttaaatgataatgaaatgtcaatttcagaaaatgtgggggcattaaataatcatctggctcgcttattaagcggttcaatttattctactttgcgtgaaagcggtaaaaaaattctttcgggacttccgccgattaaagagtttgtcaaaaaaaccgaagaacatgtcaaaggtttcgtttccccagtgggaaccctgtttgaacaactcggttttaattatattggacctattgatgggcataatatccatgaactcatatcgactttaaaaaacatgcaatcattgagcggtccgcaattcttacatatcaaaacgaaaaaagggaaaggctatgctccggcagaaaaagatcctattggctttcatggagtacctaaatttgatcataaattaggggaattacctaaatcctcaacgacaccaacttactcacagatttttggcagttggttatgtgaaattgcagcacaagatgaaaaactgatcggtattacgccagctatgcgtgaaggctccggcatggttgagttttcgcaacaatttccacagcaatattttgatgtggcaatcgcagaacaacatgcggtaacttttgccgccggtttggcaattgcaggctacaaacctgttgtagccatttattcaacgttcttacaacgagcctatgatcaacttattcacgatgttgccatccaaaacctacccgtgctatttgctattgatcgtgccggcatagtaggtgcagatggacagactcatcaaggtgcattcgatttaagttttatgcgttgtattcctaacttggtgattatgacaccaagcaatgaaaatgaatgtcgtcaaatgctctataccggttataaatgtggaaaacctgctgctgtacgttatccacgaggcaatgcaatcggtgttaagttagaaccgcttgcagaactaccattgggtaaatcaaagctgattagacaaggtaaaaatattgctattttaaactttggtactttattgtcagaagcaacaaaagttgctgaagatcttgatgcaaccgttgttgatatgcgttttgttaaacctttggatactcaacgtattcaagaaattgcacaaactcattctttaattgttaccttagaggagaatgcaattcagggtggagccggaagtgcggtagctgaaactttatatcagcagcaacaaaaagtttcattattgcaattggggctaccggataactttatccctcaaggtacacaaaaagaaatgctggctgagttaaaattaaatgctgaagggatttttgaacaaataaaacaatttttgcaaaaaatttaatatttttatgaactattttttatgttgatagtcttatagatcgctagtgcactgcaattgcagttgtctttttaatgttaaagtttcttatattaagacctccccgctattcaatctttgaatagcggttttttcttttttaacactcaacagctataaaagagcggtgatttttacaagtaatctgtaattggacttgactgataaccttaatgtggtaaaacaacgctttcaagtattttggaaggaagatgaatatgtatgaaggactgcttattgtattggttccaatgttcattggatatttaatcaaaacaaaaaataccgcacttttaacacgcataaatcatattatgatgatattgttatatatgatcttattcgtgatgggattttctctaggtcaattggatgatttagcgaaacaactaccgataattggtatctccgcctttacttttgcgttaactattcaaagttgcaatattatggggctgttaatttacgataaattaaatcccagtccattaccccatctcgccaaagaaatgccttctcgttggaaattacttcttgacagtgcgaaactttgtgcaatggtgttattaggctttgtgatcggtttatcggtaaaaagttggtttatgttaaaatttggtgcaagcacttatattctaataactttaatttttttcgtcggattacaattgcgtaataatggtatctccttaaaagaagtcttctttaataaacgtggactttatacaggtattatcttcgtttttacttcgttgttaggcggaattctttctgcttatattctcgacttgcctattacacaaggacttgccatttcttcgggatttggttggtattctttatccagcgtaatcattaataatgcttggggacccgtttttagtagcattgcttttttaaatgatttatcaagagaaataaccagcttatttattattcctttattgatgctaaactaccgctctaccgcagtaggtatttctggagcaacatcgctggattgtactcttcctattatccaacgttccggaggaattgaagttgtaccgttagcgattagttttggttttatcactaatattcttccccctattttattggtctttttttcctccatcccaatttagctaaaacgagagtaagacgataaaagtctcactctcgttttataagataaaatcatttttcatataattactcgactgctccgataagttaggaaaataattgttggctatttatatttatattcatcttgatagaataaacgagttaacagtaactttgatatcttatgtgggaattagttaatatgatgaataaaaaaaatagttatagttacgaagatttgttagcttctggaagaggtgaattatttggtgaaaaaggacctcagctaccagccccccagtatgttaatgatggatcgtgttgtagaaatgaatgaggaaggaggattgttcaataaaggctatgttgaagctgaattggatattaacccgaatttgtctttctttggttgtcattttatcggtgatccggtcatgcctggctgcttaggtttggacgctatgtggcaattagttggattttatcttggttggataggcggtcaaggaaagggacgtgccttgggtgtaggagaagtaaaatttaccggtcaaattttacctacggctaaaaaagttatttatcgtattaatatgaaacgtgtaatcaatcgtaaattagtcatgggaatggcggacggcgaagttgaagttgacggtaaagtcatttacacggcaactgatttaaaagtaggattatttcaagacacctcaacgttttgattaaataattgctattgtgttaaaaaattgtagtttctgcgaattttacatttatagagttatctagtttaaaaaagtgcggttatttttattaaataaccgcacttttcttattacttcaattcaccacaattcaaacaatataagtattgccctttgggatcattaaatttatttaaaatacctaattgctcagtcattttctgcattgatgtagaaaagccgaataaatgggcaatatactgacgaagattatgttctgaatgttgtttagcatttttcatcaactcccccaataatgacggttctttttccgttagccaaacaacagaaaaatcttttatttcttctgaagatttctgtatcactaattctctagctttttcgactgcatcatcaaaactgcccagttgatctaccagtttatacgtataagcatcaaaacctgaccaaacttgaccttgagcaattttatcaacttgtgtttttgataaattacgcccacggctaacaacatccaaaaattgatcataaccatgctctatttccaattgaataatctcactgctgattttagataacgggctgaaatgtgatttcatcaccacatcagttgtcgcaacaccatcggcattcacaccaattttttgcatagatttttcaaacgttggaaacatggcaaaaataccgatagaccctgtaattgtattagggtcagcaacaatataatctgccgttgaggaaatccaataaccgccggaagccgccattgcccccatcgaaacaacgactggctttcctgatttttgtaaattatctacttcttggcgaataatttctgaagcgaacgcacttccacccggactatttactcgcaatacaaccgcttttatatttggatcatcattcgcctcacgtaataattgtgctatgctatctccgcccacattttgttcatcactttcaccatcgacaatcgccccttcaacatttaccacggcaatagcaggttgtgtaggttgtgcaaatcgatttttcaatattgccaaataatcctcaaattcaacaaaatccaacttatcatcagaattaactatccaacgtttaatgattttttctcgttcttgcgttaccgctaattctgttattaaaccacgctttttcgcatattcagtctgatttccgttcagtgcttttaattcgctaaggtatgttttactatctggtaacacctgtgctaatggaatatcacgattttcagccacaatttgctgataacttttccataattggttaagccaacggcttgtattttcacgacttttttctgacattttatcgagcataaacggttctaccgcagatttataagtacctacacgaaaaatatgcggtgtaatttccaatttcttaaatagcgatttaaaatacaaattctctacaaccataccttctatcgccacttcaccttgtggatttaacaaaataacatccgcataacttgccaataaatattgactttgcgtatagttatccgcataagcaatcactggtttcttgctggctttaaaggcttgaatagctttcccaatgtaagttaacgcaggaatatctttcccatcaaaataattgagatcaagaacaagtgcggtaatttttggatcttttttagccgcttgaatggcattaacaacatcaaacgttgagatttttctcggtacatgttgattacctaattccaaaagaagctcttgccatgccgtatcatcgctacgattatctgccaaatagccgtccaaatttaatagcaacgcccctttaaaatgagttaaatctactttattcgacatactcgaattaaccgaaaacactgctacaatcaataaaacgaaaaaaagaaatactatattcattacaacacgacgagcaaaattgagcatttgccagcacaatttgagaaaggtcaacatcactttcatattatcctttactaagttaaaacaaatgtcgtaccttaccacaatttccttttacttcatatcgatcaaggtaaaaatatgctagaatccaccgcacttttaagatgaaaaacaagatggaactaaaatggacgctctacaacttcttaccactcgtcattcagaaaaaaaattaatttcacctgctccaactcggcaacaacttgaacaaatttttcacgctgcactgcatacaccggatcatggaaaattacacccctatcgttttgttgttatagaaaaggaagggttgaataaatttacagagttactaaaagaagctgttttggaattagatcttggacaagagcggttaaaaaaagccgagaatttatcccaaagagcacctatgatcatcggtgtaattgccaaaataaatcctgatattgaaaaaataccggcatgggaacaaatgattaccgcaggttgtgctgcttacgctatgcaattagccgcaaatgcacaagggtttgataatgtttggatcagcggtccttgggttaaaggctctgctttgcgtcaagcctttgattgtgaaaaaaatgataaaatcattgcattattgatgcttggtacagcagaacaaaaaagtgatcgaggaaatcgagaattgaatttagataagtttgtgcgttatttatagattttatgtagcccaaattttcactgggctaaaatctccccttataattaaaaaataaatataactcatttttttaacaaggttaaaaactcttttctggtttctctgtcgtccaaaaatactccgcctaaagccgatgtcacagtgtaactattggtatctttaattccacggcattttacgcaaaaatgcgtagctttaacataaacggctacatcttccgtttctaaaatggtttggaatgccaacaaaatttgttgagttagacgttcctgaacttgaggacgttgtgcaaaaaaagcaacaacacgattaattttagataaaccgatcacccatttttgcgggtaataagctactgatactttaccatcaatagttacaaaatgatgttcacaagtactggttaaagtcacatcatcaactagcaccatttcacttactttcatgcggttttcaatattagtaattttagggaaattagcgtaatctaaaccactaaaaatctcatcaataaacatttttgataaacgtgccggtgtttcctccaaactgtcatcagataaatctaaaccaatcagttttataacctcacgcatatgttgttcaataccttgacgacgttgatctttatcttgcataagatcaatcattggtgtttcaattcctttttcaaccaaagcattacgaaccttaatcgcttccggagataaattgctcatgactacttcccgtaaaatcgttatatcctttaaaaatgcctgacattctagcaaataaaagctgaaatctctatttattaggtataacaattactgaatttaaagtaaaatgtgagctgttttttcacattattacaaggatttctatgctatctcttgaacaagctttacagcaaatgctttcgcaattagcaactataaataaaactgaaacgctaacattggaacaagcagtggctcgcatttgtgcagaggatattatttcaccgattaatgtaccgtcttttgataattctgcaatggacggttatgcagtacgtttggcagatttgaaacattcaacaacgctatctatatgcgggaaatctttcgctggtaatccattcaacgagcaatggcaagaaaaaagtgttattcgaattatgaccggagcaatgcttcctgaaggtactgatgccgttgtaatgcaagaaaatgttacaataaacgaagacggcacagttaccatcaatgaaatacctaaattgcaccaaaacattcgtcgtttaggagaagatataaaagtgggtgatattgcattaaaaatgggctcaaaattgaccgcacgttcactcccgcttttagcttctttaggcatctctcacgtaaaagtttataagaaacccaaagttgctctattttcaacgggcgatgagcttgtatccgttggacagcctttagtacaaggaaaaatttacgatagcaatcgctttacaattcgattaatgctggaaaaatttccttgtgacatcttagattttggtattcttcccgatgatgaacaacttttcgagcaaactttctttaaggctcaaaaacaggctgatttagtgataagtagcggtggagtttctgttggagaggctgattttaccaaagctgtcttagaaaagtgcggtgaaattaatttctggaaaattgcaatgaaaccgggcaagccttttgctttcggtaaattaaataacgcttggttttgcggactgcccggcaatccggtttcagctttagtgacgttctatcaacttgtgcagcccgtaatagcaaaattaagtggctatacacaatggaaaatgccacaacaattaaaagcaatcagtgctacaaaattgaaaaaatctgttggtcggattgattttcagcgtggtttttaccaactcaatacacaagggcaaattgaagtttatcctgtcggacaacaaggttctcatctttttagtgcctttgtgaacagtaactgttttattcgtttggaacaagaacgtggaaatgtcgaagccggtagcatcgttactatagaaccttttagtgatattttaaactaggatttttatgcaaatcgaactctcaacaatagaagaattacgctataaccgtcaaattatcatgaaacaaattgattttgatggtcaagaaaagttaaaaggcacaaaaatgcttattgtcggcttgggaggattgggttgtgctgctgctcagtatcttgcttgcacaggtgtagggcatttaactctccttgattttgatactgtttctctctctaatttacaacgccaagtactgcataatgatgagcgtttaaatatgctcaaagtacaatctgctaaaatcgccctgcaacaactgaatcctcatattgaaattcaatgtattgcagaaaaattgaacgaagaaaaacttgctgaaattgtaccgcactttgatgcagtcttagactgtactgataatgtagaaatccgtaatcagctagatcgctgttgtttggctacaaaaacgcctttagtatcaggtgcggcaattcgtatggaagggcaagtttcggtgtttacttatgaagaaaatacaccaacttaccaacatttaagccgtctattcggtgaaaatacgctaagttgtgtggaagcaggtgttttatctccaatagtcggcattgtaggggcaattcaagccttggaagcaataaaagtgcggttaaatataggcaaaattttatcaggacgtttattgatgattgatggtttaaatatgaagatacgtgaaattaacattccgtctgaataaaaactcaatatccttacaatctctaagataatgctggattgcctaaaacacaggtttatcaatcaactgttttcaaagtagcaaagattcaggtagcacgccattatctccacgatgtacccgcataccttcaacccgcacacgtcccgtcacacaatcagctatggcttttggtaacaaacggtgttctgctgctaaaactcgtgccgccaatgtttccggtgaatcatcatcggccacaggcacagccgcctgtgcgataatcggtccgcaatccatctctgccgttacaaaatgcaccgtacacccaactacacgacatcctgcctccaatgcccgacgatgcgtatccaaaccagtaaatgcgggcaataacgatgggtgaatattaatcagcctcccagcataatgcgtgcaaaattctggcgtaagtatcctcataaagcctgctaaaacaacccaatcaggctggtattcatcgatttttctcatcaaagccgcatcaaaatcgctacgttcaggataatctttgtgactgaccacaccggtagcaataccttgttcttccgcccatgccaaaccagcagcatcagctttattagccaataccgccaccacatttgcaccctcaattcgagcttcaactacagcctgcatattactgccacgccctgaaattagaattacaatgttttgagtgttcatttttttccttcaatttttccttcaatcaaccctgccgggattaattgctttgttgagatggcacaaacatcgttttaatcaccgcaacttcagattccccctaaattttatcaacccgtccgattcgaaaaagattctaagtacgaacaacaaagatggtgaagaatatggattggggtagcccttaaaaggctatggctctatggctatggctatttgctattctccacccatttaccatcaacaaaataggcactccattttgttgttttaccatttttctctgaggtaacatattgacgtttttctttacgactaaagcgaataattgcctcattaccttcaggatctttaactggcgcatcagctaaatagcgtaatttttccggcaggcgatcttgatattgagccaattcagccacttttgcaggacgactttctcgtgattttggaaaattatgtgctgacataaacacaccactcgccccatcacgcaatacaaaataagcatccgatttttcacattttaattcaggaaaatgtacaggatcctcttttggcggtgccacttccccactttttaaaatcttccgagtattatcacaattcgtgcagcccatgtatttaccgaaacgtcctaattttaagtgcatttcaccaccgcacttatcgcattcaactataggaccttcatagcctttaattttatattcaccttgttcgaccaaatagccattgcaatttggattattcccacaaatatgcaattttcttgtcgtatcaatcaaataactgtccattgcagtatcacatttcgaacaacgcttacgttccattaaggcttttgtttcagagctttcatctaaaacatttaataattccgcttccggaattaaatttattgtggttttgcaccgctctttgggcggtaaggcataaccggaacagcccaaaaaaacaccggtactggcagtacgaatagccatttggcggttacaagttgggcaacctatatctgttgcaaccaaactatttggtttcattcctccgtccaattcatccaattcagcttgtgttaattgttggctaaaatctttaaaaaattgatttaattcttctttccaatttttcttaccgtctgcaatttggtcaagtatattttccatattagcagtaaaatcatagctcattaaatcagcaaacgattggttcaatcgatctgtgacaatttcccccattttttctgcataaaaacggcgattttcaactcgaacatagcccctttcttgaattgtggaaataattgcggcataagtagaaggacgaccaatccctcgtttttccaattctttaactaaggcagcttcactaaaacgtgctggtggtttggtgaaatattgttgaggttcaaccttagttaaacttaatttctctccaactttcactatcggcaactcttgatcttcagggtttctattcgattgaggtaatacttttgtccaaccatcaaagcgtaaaacacgtcctttcgccttcaattcataatccccagactgcacggttacggttgtgctatcatatttagcggctggcatttgacaagcaacgaattgtcgccaaatcagatcatataaacgcacagcatctctttccattccctctaaactgtcagccaattgttttacatcggaaggacggattgcctcatgtgcttcttgtgcattttctttactggaatagaaattcggtttgtccggtaaataggcttgtccaaattcttgcacaatataattacgcaccatttctaaggcatctttacttaaatttgtgctatctgtacgcatataagtaatgtaacccgcttcatataaacgttgtgctaacatcatcgttttctttacgccaaaacctaattttgtgctggcactttgctgtaaagttgaagtaataaaaggagcttttggttttgacgtcgttggttttatttcaagatctttgacgaaataatcggaaatttgtaaaaaatctaccgcacttctcgcctgttcgatatttttaggttcaaattttttcccttgaaattgtactacatctaaacgaatagatcgtttttgactgtttttactatcaacagaaatttcccaatattcttgaggttgaaaagccttaatttcacgctcacgctcaacgactaattttactgccacagattgaactcgaccggcagatagacctcgtgccacttttttccaaagtaacggtgataccataaaacccactacacgatctaaaaagcgacgagtctgttgtgcattaacacgatccaaatttaactgttcagggttctcaaaagcttgtttaatcgcatttttagtaatctcattaaatactactcgactaaaacgactgtcttcaccgccaataacttcgcgtaaatgccaagctatcgcctctccttctctatccaaatcggtagcgagataaatatgatcaactttttttgctaaagatttgagttcagaaaccactttctctttaccgggtaaaatttgatacttagcttcccaattatgataaggatcaatccccattctttttaccaacgcattttgctctttttccgtttttatgcgttgtttttcttccgcacttaatcccttcgttgaaataggtttcgctttttcaccgctactttcacctaccgtaggcagatcacgaatatgccctacactggacttaactacatattgattacccaaatacttattaatagttttcgcttttgccggcgactcaacaattactaaggatttactcatatttttatttacctaattcgctgtatttttgtaaaattgcccgctatattgcttactatcttttgcaaggtcaacagttttttataaaaatgggtataaatgaataaactaaatgcagtttcaatcatctgtaaggttattaaaatatacagaactcttaaagctacaacgtaacaaagcatttaccccatcatgtttacgctaaactaaaagcattgattcattttgttatcagcttatatttgtactaaacgacacgctaaaaataaggtaagttaccttattttccctcacttccccagcgaagaaataaatcttgttctaattcaataccaaattgatcacatacacgattgacgctttggttaataatatcatctaagttactgggtttatggtaaaaagcaggcattagaggggtaatctgtgcacctatttctgccgcctgagtcatcaaacgtaaatgtcctaagtgtaaaggtgtttcacgtacacataataccaacggtttacgttcttttaagcatacatcagcagctcttgtcattaaatcatcggtatagctatgtgcaatacctgacagggtttttattgaacaaggcaaaattaccatgcctaaagtgcggtaagatccggaagaaattgccgcactaatgtcccgaatatcataaactttatcggacaattctcggacttgttgtaccgtaaattgtgtttcaagtgcaatagtctgtttcgccgcttggctaataataaggtgcgtttcaatttccggaagggattttaaaatttgcaacaaccgaatagcataaatggcaccagatgcaccggtgatgccaataattaaacagtcttttttaagcttcattgtgcatttcgagattcgtggcatctttttcacgctttttctttgctttgtcattacgtaaatcggcaacttgatccaaatacgctgaggtaatatctccagtaacataaacaccggtaaagacagaacaatcaaaatctttaattgctggattttcttgctgaacagctctagttaaagcatcaagatcttggaatataagtttatccacaccaatgagtttagcaatttcatgaacatctcgtccataagcaattaattcatttttagtaggcatatcaataccatacacatttggataacgaatttccggtgctgctgaggcaaaatagatcttatttgctcctgctgctcttgccatatcgacaatctgtttcgaagtcgtccctcgcacaatagagtcgtcaaccaacaacacattcttacctttaaattcagaagagatggtattgagcttacgacgtaccgcacttacacgctgagtttgccccggcataataaaggttcttcccacatagcgatttttcacaaaaccttgtcgataaggtttatttaaaatatgtgcaatttgtaacgcaatatcattggacgtttcaggaatgggaatcacaacatcaatatctaaatctttccattcttttgcaattttttgtcctaagttttctcccatgtgaacacgagccgcataaacggagacaccatcaatataagaatccggacgagcgaaataaacatattcaaagatacaaggcgttaacttaggattttctgcacattgttgtgcatataactgaccatcaaaagtaacataaacggcttctcccggtgctacatcacgaacaaattcaaagtcagcaatatctaacgcgatactttcagaagcaaacatatactctgttttaccgcttacctcatcttcacgttttcctaatactaacggacgaataccatttggatcacgaaatgcaactatgccataaccaatcatcattgcaacacaagcataagcaccacgaatatctttgtgagtagctctaactgcctcaaaaatatcctgcgtagataaagggtgtgttgtttgatccaaatgatgagccaaaatatttaacaaaatttccgaatccgaattggtattgacatgacggcgagcaaaggtaaagagtttttgttttaactcttctgaatttgttaaatttccgttatgcaccaaagttaaaccgtaaggtgaatttacataaaatggttgagcttcagagacactggaacttccggcagtaggataacgcacatgaccaactcccgcattcccttgtaaacgtagcatgtgaacttgctgaaagacatcacttaccaatccatttgcttttcgtaagcgaaaacgattttcttcatctactgtgataatcccagccgcatcttgcccccgatgttgcaataccgtcaaggcattataaatagactgatttacagggctatggctaacaatacccacaattccgcacatatttcacgttccttatttattcaatgttgaatttattaaatttgaatttgcttgtatttgttcaaaaaaccattccacaataaagccaaagtgcggtattaattttgatgttttccaccaatcactctgtgcaaagtttgtgaaagaatcaataaaaaatagcaatgccgccacgattaatatacctcgtagcaacccaaagcaagcacctaataccctatctgttccggttaaacctgttttatcaactaactgactgataatgtagttaagcattgcaccaacaatcaaagttgctacaaataagattgcaatagcaaccgcattacgaacataaggtgcttctatttgagttaaataagttgctaaatagggataaaaattatttgccaccaaaaaagcaacaatccagctggcaagcgacataacttcacgcacaaacccacgcaataaactgataattatagagaataaaattattccgataatcattaaatcaagataattgttcattaggtaacctctaaaatcccatcaatttaagaccgcacttattctagcaaaaaaggaaaacgtttgcgtagtctaaattcacgctttatgcaaatttaatcgaaataaaaaagaagaaatcagaattgtcgtctaaaaatatagatggaaatatcaggaaatgtatcctttcagtttaaaatccatctgtctattcactaaaacactagatgagagatgttgagttagtcgataagccgggttctgtcttggacaatcattcatctaggcgtacatttacacatacgctcaagcaacctacccgaactctgagcgggcaactcattgagttcctatttggtcttgctacgagtggagtttaccatgccataaaatgttaccattcatgcggtgtgctcttaccacaccctttcacccttacctgatctcttacgagccattggcggtctgctctctgttgcactggtcgtaggctcacgcctcccggacgttatccggcactctgccctatgtagcccggactttcctctcgtttacttatgcctctaagtcgtttaaaaacggttaaagatttcaacaaaccagcgattgcctgactaactcgatgcggagtatagcgtaaaattcagataaaatatagagttcacccaaaacttgcggtaaaataaccgcacttttcaatgaggaaatgacgatgaattacttacaaatcgctcgaaattcgttagctgccgagcaaaatgctttagctaaacttagtcaaaatttaaatcaacagtttaatcaggttgttgagcttattttaaattgtgaaggacgattagttgttggcggaatcgggaaatccggacttattggtaaaaaaatggttgctacatttgcctcaacaggaacaccaagtttttttctacatccaacagaggcttttcatggtgatttaggtatgttaaaacctattgacattgtgatgttaatctcttatagcggtgaaagtgacgatgttaataaattgattcccagcttaaaaaattttggcaataaaatcattgcattaacaggtaacctaaattctactttagcaaaacatgccgactatatccttgatattagtgttgagcgtgaagcttgtcccaataatctggctccaacaacttcggctttagtaacgttagctttaggcgacgctcttgcggtttctttaattacagccagaaactttcaaccggctgattttgccaaatttcatccaggcggtagtcttggtcgtcgtttgttatgtagagtgaaagatcaaatgcaagttcgtttaccaaaagtaacagaaaacacaaactttactgattgtttaaccgttatgaatgaaggtcgtatgggggttgctcttgtcatggaaaatgaaaatttaaaaggtattattaccgatggcgatattcgccgtgcattaagtgcaaacggaactaatacacttaacaaaacagccaaagatcttatgacttccaatcctaaaactattaactataatacttatctgtctgaagcggaaaactttatgaaagagaaaaaaattcattcattagtcgttgtagatgatcagaataaagtgataggtttagttgaattttcgagttaatcccatgatgttattaaatgaaaaattacaaaaaattaagctggttattaccgatattgatggtgtactaacagacggcttattgcattatgatgccaacggggaagtaatgaaaagtttccatgtgcgtgatggactgggtatctgtatgttaatcaaaaatggcattcaagttgcagtcttatctggtcgagactcccctatcttacgtaaacgcattgcagacttaggcatcaatttatttttcttaggtaaattagaaaaagagagtgcttgttttgaattaatcaaaaaagcaggtgtaacacccgaagaaactgcatacattggtgatgatagcgttgatttacccgcattttccgtttgcggattgtcttttgccgtaaatgatgcgatggactatgtgaaagattgtgctgatcatattttgagtttaccaggggggaaaggtgcctttcgagaaatgtctgatatgattttaaaagctcaaggaaaagcaagtgtctattccacagcacaaggtattctcaaagcagttaacaagatggtgcaataaaatagataatgaaaataacagtccacatacaaaataagcggactgttacttgtctgtaaaatatctctaaacacaactaaaatccccgcaagcaacgtaaaaaatacttttcacattctacccattcattcattaatttaataaccacattatcgatcaccgcacttacataagctaaaccttacatcataattacctattcgtattctaaataacaatagttattattaaaaatacccttttaaattaataacttataaaaaaataaaagttgcattccatgaaaaactgattaaaataaaacctgttttattcatcaataaaaaaggaactcgctatgctaaatcaagctattattactaagttaaatgaacaaattaacttagagttttattcatctaatgtatatttacagatgagttcatggtgtgctcataacggctatgaaggtgcagctgcatttttacttcgacatgcagatgaagaaatgcaacatatgcataaattatttacttatgtaagtgaaacaagtggtatgcctctgttaggtaaaattgaagcacccaaaaatgattacaaatctttaaaagaaatttttgaaataatcttagaacacgaaaaatttgtaactagtaaaatcaatgaattagttgaaattacttttgcaaccaaagactattcaacatttaacttcttacaatggtatgttgcggaacaacatgaagaagaaaaattatttaccggcattattgataaattcaatttgatgggcgaagacggtcgttctctttactttatcgatcgtgatttacttactttataatagataggacaaaaatatgttatcagcaaatgttatcaaattattaaatgatcaaatgaatttagaattttattcttctaacctgtatttacaaatgagtgcttggtgtgagcaaaacggttttgacggaacagctaaatttttagccgcacatgcagtagaagaaatgcaacatatgcgtaagttattcacttatttgaatgaaacaggtgcttcggcaatcattacggctattgatgaaccgccacatgaatttgattcattaaaacaagtaattgaactaacatacgaacatgaaaaactcattacctgcaaaatcaatgaattagtcggaaaaacctttgaagagaaagattattcagctttcaatttcttacaatggtatgtagcagagcaacatgaagaagagaagttatttagtggtattttagataaaattaatcttcttggtgaagatggtaaatgtttatatctaatagataaagacctcggtgatttgacaagtaaagtataatctatagaagatcaaatctaatctgacagtccctgtttaaaattatcatatctgtcagattagtttgagcttaagttttttctatctaagtacattttccatcaagtgatgttgctattaatctctcacttaagcacgtttttgtgggattataataaagctctctttttgagttactatgccttttaccaaaatgagtaaaaaaataatcatttgtagaatcatactaatgacagtttaaaaatatcacttgatagtaattgacaatattcagtagacagtcctttatctgtgataatttgtgtaaagttattaagttgagttgcacaaaataaggaatattttccatatttactgctatcggcaactaatactttttgtttggcattttgttggagcattctttttaaatgagctttctcttctgtaggtgcggtaacacctttttccaaactccaagaattacaacttacaaaagcaatatcaggattaatgttattcaataaaatcaggctatggttaccgatacaggattggctactattatccactcttcccccggttatggtcaattctatttgtttatattcggaaagtaataaagcgatatgcagatcagtcgtaatcactcgaagtggcatatgagcgattttttttgcaatgcacaaagttgtagtacctgcatctaatacaatagagtctcccggagaaatgagagaaacggcatattcggctatccgctctttttcagtaatttgcttaagttgcttttcatttgtagttggttggaatggaataaagtggtttaaacttactcctccgtgtgtacgaattacaacaccttcttcatctaattttattaaatcacggcggatagttgcaggagaagcatcagtaacctttaccagctgttctacggtagcaatattatgactttttagaaatagtaaaatctgctctagacgatttttagacatataaactctcttatttgtaattattttactataaataattttttgaaaataagatagtgaaaattaaagaacctaaaacattattgctttaggttctttagtattatttctccattatgtggcttaaaagtacttcgcttccaaatccaccggatttggtcattacaacgatgtctgaatagttaccttcttcaattaagcataaaggcactcccggtactactgcatataatacgttcatttcagttacattcatttgatccaataatgctgcagccccatctccaccgaatagtataagactatcaaatttttcattatcaaggcagaatttacttaaatcagctaagtgttgagaaatttctttagcggtttcagtaatatttgccgattttgcatttacgacttttgctgggtttgctcgaataatcacattatccttactaaaacgtattagagcgtttaattgtagttttagtgaatgttctgactgcgaatagttcatcaactgcgaaggtgaaggatgaaatacaatcgattttccacctaaagttgaaacatattcatcaacttgaagctggcttgtttcgtggattgatgttactacaattaatgttctacctaatgtaatctctcgctttggtctcggtttattttgaatatttttcaatttctgtgctaatccagctgagccaacaggaataattttatttcctatatggtttataacttttgcaataattgcaagatcttcgtgcgttttagcatcaataacgatctgtttatattcactattttcaatagatgcctgcaaattatcgaccgtatcacacggaattacttgagcatcaggcaataattcttgcatagaggaagacagtacagggcaaataggatctttgcctgaagcagtttcctttacaggaacactattaacatataaatgaccagcttctatcgttctccccatttctggatatgcaggacaaataattgctttaacgtctggatataaactagcccaagcttcaatagcaccttcaatttgatattttacagagcctctcattgtagaatcaattttgaggtaaatttgcccaataccattttggatagcattactaattgcaatttgagtttgtttttttgccttttctccaatagctcttgagtcagtagaaacagaaattacttgagctttatcagattgcatttgtgctaatgccgaaactttagtttttaagacagtgttaaaccctgcttcagcaaacataactgcggtatcatttgcaccggtaagatcatctgcaataactaagagagtttctttcatagcttttccccttttactgtttcttgtgctaatccaccttgacgttttaaaacccaagccgcaaataatggagctaaaacagcggaaactaatacagcagctgcaatttgtgcagtagcagtttgcaccaaaggtgctagtgtaggatctgcttgagcaacaatttcaggtgtaattatggcatttccagcagtagtaccagcagcaaatccaatccctgattgattacctcgtcttaaaatagttttgtaaccgataaacacaaggaaacctgtaaagagagaagctactatacctaaaataatacctgttgctccaccagtaataatggcctgtaagttaatacctgtacctaatgcgaaagcaaagaaagggataacaatagcaccagttggtttcattagttctgtccatttaggatctaagttaccaataaccataccaacaatcagaggaataacagctgcaagcatcaatgagaaaggaatatcagctaatcccgatacacctaaaaatagtaaaacaaagaaaggaccgtcattaactgcagaagcaatataagcccctttatctctataatcgccatattttcctgtaaatgctaaccaaatacccccatttgaattagccacaacagtaagcatagctaataaagaaacccccataacaccatcatttcccacccataatcctaaaaaaacaactaaaagagcgggtataattgttttaaataataatacaatgccggtatgagcaagaacaggaccggaacttctcacagtaatttgcatacctgttgcgaaaattaggagtgcaataagtgagcctgctgatgatttgaataaagctgtcgtaaatgaacctaaattcaaaaagtcaggcaaaaacgtaccaataatagaaccaaaaattagtggtattaccattgccccaccgggaattttattcataccatcatatattggaacgatggatttagatacttgagtagacatattaatctccttagtgtgttgcatatttgatgtttgccatttttgcacctagatagagtgcttcagacatactacggctatcggcaactccctttcctgcaatcggaaatgcagtgccgtgatcgacagatgttcgaataaatggaagaccgacagtaacatttacacctgtatcaaaacctaataatttgatagggatatgtccttgatcgtggtacatcacgacgacaatatcgaactcgtttagattagctgcacgatgaaataaagtatccggtggtataggtcctgtaacattaaatcctttggcttgagctgctagaattgcaggtacgatttctttttgatcttcatcaccaaacattccattttcaccagaatgagggtttaaaccggcaacagcaatacgaggctctttaaagccaagaatacgagcattttcttctgccaaatcaataacagtggcaactcgttctttagtaactaaatcacaagctttacgaagttggacgtgagtagtaacgtgaataacgttgagtttttcgctggttagcatcattgagtaatctttagtattactaagggtagctaaaatttcagtatgaccgggaaacattttaccacttgcatgtaatgcctctttatttaaaggggctgtaacaatagcttggattttcccttccatcgctaacttaacggctttttcgatgtattcataagccgctttaccagcacgaggatcaatttgagcaaaaggcaaatcttctgataagttattcaaatctaaaatatcaataacaccatactctgccgtaaagctatctagatcatttaatattcttaatttcagttctgaatgaacaataggtaaagctcgttgcataattttttgatcgccgataacaactgggtgtgctaactcataaatccgtttatcagccaatgctttaataataacttctgggccgatacctgcggcatctcccatcgtaattcctaaaataggtttcatttccactccttgattgaaattaatcatttttagcaaattatatcgcaaataaagagataaaaatgtgattaaagtcaaaaaatgatcttttttaatcgcattgattttatttaatctaaaggtaagggttataaagcagattagaaaagtaaaatgttatttaatttgaataaacacttccctttttagcaaaaaacggtatcattacgcctcttaaatgtaaccctacatttaagtttgtttccaacctatcctatcttgggacaaatagggtaaaaacaaaaaagctggaacgctttttttaataagtagcgagtcaaatgccccatggcgtctagtctctctggatttgagagcttaggcttcctccgcaaggcacccgacttatttttttcacctcttttagaaggtttatttcaatgacaattaaaacccctgttcaagcaactcttgcttcaaatcaatactttttagatcgccaagatataatggaatcaaacgtgcgtagttacccgcgtaaactgccgtttgcttatcaaaaagcacagggcgtttgggtaactgatgttgaaggtaatgaatacctcgatttcttagctggtgcaggaacgcttgcattaggtcataatcaccctaaattaattcaagcaattaaagatgttttagacagcggtttgccgttacattctttagatattaccactccattaaaagatgcttttaccgaagaattactctctttcttccctaaggataaatacatcttacaatttaccggtccatcaggagcagatgctaatgaagcggcaataaaattagcgaaaacctatacaggtcgtggcaatgtcattgcattctctggaggtttccatggtatgacacacggtgcattatctttaaccggtaacttaggtgcaaaaaatgctgtgcaaggtttaatgcctggtgtgcaattcatgccttatccacacgaataccgttgcccatttggtattggcggtgaggctggtgtgaaagcggttgaacattattttgaaaactttattgaagacgtagaaagtggtgtggtaaaaccggcagcagtaattttggaagctattcaaggtgaaggcggtgttgttccggctccaatcagcttcttacaaaaagtacgtgaagtaacccaaaaacacggcattttaatgattgtggatgaagtacaagccggtttctgtcgttcaggaaaaatgtttgcctttgaacatgcaaatattgaacccgacattgtagtaatgtcaaaagcaattggcggtagtttgccattagcggtattagcgattaaaaaagagtttgatgcgtggcaaccggcaggtcatacaggcacattccgtggcaaccaattagcgatggcaacaggctatgtttctctcaaaattatgcgtgaagaaaacttggctcagaacgcaaaagagcggggtgaatacttaactaaagccttaactgaattaagcaaaaagtttccttgtatcgggaatgtgcgaggtaagggtttaatgatgggtattgacattgtggacgaacatcaagccaaagatgcaacaggtgcttacccacgtgattgcgatttagcggtagctattcaaaaatattgttttaaaaacaaattgttactagagcgtggtggtcgtggtggaaatgtggtgcgtgtgctttgtgcagtaaacattacccaagcagaatgcgaggaatttattaaacgctttaagcaatctgtagccgaagctgtgaaagcggtacgtggttaatttttgataaaacaagcggtcatattttgcaaaaaatttgcgaattttgaccgcttgaattgtatatagcattgaatgagataacaaaaatgacagatatttccaaacacagacaatcgctattttgtagcgatccacaatctattgcggattatgaaaccgcaatgaacaatgcggtacaagcggtatcaaattggctaaaaaatgaaaaaatgtacaccggcggttcgatcaagcaaatgcgagccttgattgacggcttcaagccgaccaaagagggagtgggagtgcaaaaatctcttgagcatttggtagagattttcctcaacccaagccttaaagttcaccatccacactctttagctcacttacattgcccgacaatggtgaccagccaaattgcagaagtgttaattaatgcgactaaccaatctatggactcttgggatcaaagccctgcgggatctattatggaagagcatttaatcgactggttacgccaaaaagtcggctatagtgaaggtacagctggggtgtttacttcaggtggtacgcagtcgaatttaatgggcgtattgttagctcgtgactgggcgattgcgaaccattggaaaaatgaagacggctctgaatggtcggtgcaagcgaatggtattcctgctgaggcaatgaaaaacgtgaaagtggtttgctcggaaaatgcccacttttcggtacaaaaaaatatggcgatgatgggaatgggcttccaatcggtagtcactgtgccgtcaaatgccaatgctcaaatggacttagaagcgttagccaaaaccttagcagacttgaaagctgacggtaaaatcgtagcttgtattgtagcaactgcaggcacaacagatgccggtgcgattgatgatttaaaagcaatccgcaaattggcggacgaataccaagcgtggttacacgttgatgctgcttggggaggtgctttattattatcgaaagattttcgtcatttcttagatggaattgaattaaccgactcaatcacgctcgacttccacaaacatttcttccaatccatttcttgtggggcattcttgttaaaagacgaggcgaattatcgtttcattgattacaaggcagattacctcaactcagaatatgacgaagaacatggtgtaccaaacttagtagcaaaatcactgcaaacaactcgtcgttttgatgcgttaaaattatggtttacggtagaagccttgggtgaaaatctgtatgcttcaatgattgatcacggtgtgtatttatcaaaagaggttgaggcttacattactgcaaccgaaggcttggaaatgttagtacctgcacaatttgcctcagtgctgttccgtgttgtaccgaaaggctatccggcagaatttgtggatacattgaaccaaaacgtggctgatgagctgtttgctcgtggtgaagcgaatattggtgtcacgaaagtcggcaacaagcaatcactgaaaatgacaaccttaagcccgattgctactcttgaaaatgtgaaagccttattagcacaagtgttggcagaatcagaacgcatcaaagattctattgtaaacggcacctatatcccgcctattgattaaacgattggcaaaattatacctaaatcagaccgcttatcagccttgaattgattaatgagcggtcaattttttaactttttacaaattttattgaaagttctattgttcataacaagttaatcaaccattaatttcctcaatacttcacttaacccactttgacgctctgtcgctttacccaccgccatattccatattttgcggtcggaaaaaatagtaacttgattgattgctcttgttactccagtataaaccagttctttacataaaacaggattggcttcacaaggcaaaaccacaaaggtatgggaaaattctgaaccttgggatttatgaatagtcatggtaaatgctggactatgctcaggaatacgacttgctaattcagccttaccattttcaaaccaaaaatgcccttttaagctaccatcaggttgtttttctgctaaatacaacgcaatatcaccattagccagtccgagacggctattattttcagtaataatgattggttttccgatataaaaatcacgactatgattaaattgcacaagtcctttttgctttaattgttctgcaataagttgattgagattttcgctccccaattctcctaccctaagtgcggtcaaaaatctcactttattgaatgcagcaaaaatatccgcaatatgcggtttaatcggtaagttattttcaataattttgtgaataagctgtaaatattctgcataattttgtaccgcactttgcacgaccaattgactgcaatattgagaataatggtgtgctaatggctgttcatcaatattagtttgttcatattgtgtagaataatccactaaattgatttctcccgtgtcgtttgtgttattttcttgttgatattgatgaaataattgccaactttcagcaattttttgttggttaattaattgagctaatttaccaatataaggatgtttaccgaaacgacgactgccctctaagttgcataaacaatcacgaataagattttcatctgcatgatgttctaagttttcccctgttgtttgctgtaaataatctgctaactttgaactaattgaatattgtctaaaagtacccaattcagccaaaatcgctcctgcttcaacagaggataactgatccttatcgccaagcaaaatcagcttacaactcggtttcaaggcttgtaataatttcgccattagaaacaaatccaccatagatgcttcatctaccaccaagagatctatcggtagtggattacgtttattatatttcgtcttttcttcaaaaaatcgcacaccaattaaactatgaatagtttcagcattaaaaggaatagcattttttatatgttcactaactttaattaactccttttttgtcaataaattaaaggaatttttcatactaatttttaagcgttctgaagcttttccggttggggcaactaggcgaataactaattttccctctgccaactcctgtaatgccaataataatcgagtaactgttgtcgttttacctgttccgggtccacctgtaatcatgcaaaaaggttgatgaattgccgttgctacagcaattttctgccaattatgcttttgttttaaactattatcttcatgctctaccggaaagtatttttgtaaaatgccttgaattttttctatcggatatggttgattttctttctgttttattgttcgaattaaaaattcggcaattcgatgctcatcttgccatgtgcgataaaaatataggcgattattttgtagcaccaagggctttacctcattaataggatcttgagtaaatgcgatatgattaatgagtaaattttgccattcagattgtgtaatattccctattttctctttaatatcaataaggtaacttttttccgcataaggtaaattaaacagatttctaaaagaaaaattttctatttttaagcacgtatgtccttgttggttatgaaaattacaaagtgcggcaagtaaaatagctaaatttttaacttgtgatgaataatctaattcccgttgtttatctgcaatcaactttgcaaaataataatcaccagcttgaataaatttcctttccttaagttgatacaaaatatttagcattaaaataaactctccaattcagaaatcaaacgccaatccggtttatcaaaaaatatcccggaattatcttttccattcattccacgtaaaaaagtataaagtacaccgccgaaatcacgttggtaatcataatttttatcccgctcttttaaataacgatgtaatgcaatggtataaattaaatactgccaatcataatgattattacacatcacttgaattagattgtcttgctgataatgttgagaagaatagcctagtaaattagacttataatctaataagtaatacttgccttcaaaacgaacgaccaaatcaataaaacctctcaccatacctttaattctatccatcagtatcggtgatgacggtaaatgatgatacttacttaacagccgattaaagacattttcattaaatgattgatttaatttcaaataaaattgcatttcttttaaacaatcttgcgacttgatattgcctaaagtaaagcctgcaatatcctgttttaaaggcgtattaaaaatcgcatttatccattttttcaatggattttgccattcatcacttaattgtaacgtctgacaaagtttagataattggtcatcattcaatgcctgcgtcatattatatttttcaaaataacgatggaattcgctaccaacatggacaccatgaggaaaatcaaacggtgaaaaacctacaggataatcagagtctgcactcaactttatatcaaatgacgctgacatatcatgaccattttctctcacatcatgatctcttgcttgatcaaaaactccggatatttcaatctgctgtgctttttgtcgagaatttaaagatctgttacgttgatgacggtaggtcatttcagtaaaacttgttacagtccaattacgctcaatcttgccatgaaattcttccgcttcaaccggcgacaatgcctgttgcactgtaatatactcatttctccttactaatagttttttatcttcctctatttcaacacattgttcacctaattcctcaattattggacttaacaatttttttgcatcatattcatcatcaattcttttatttgcaccaatttgtcccttagttaatacataaagtaacgcattccattttttctcaaaaatgcgaggaaaattaataacaatctgatatttcgctcgagtaagtgcgacatagagtaaacggatatcttcagccatacgctctttttcaatttcatcggaatgttgcttatccatatcccataacacttgttcttgattttcatcataataagtattaatggcattatctcggaatagggacggcttacaaataaaaggaatccaaactaaatcataagcaagccctttagatttatgtaatgtaacaatcttgactaattctcgatcactttctaaccgaatttgttcttccaagcgttcttcgccttgaatctgtttctcaaaccaacgaactaaggaggactcggtatcatttaaacgggtagcctgttgcaataactcacttaaatgccacaaatcagtcatttttctctcaccttgttccatcatttgtaaattttcattaattttttcaactgcaaataaatgatgcaacataggtaaaataccctgcctttgccattgttgttggtaagcaataaatcgctcaacacagttttcccataagttctcatcttgcttaatttggaatatttctgcaccggttttagcaaaaagagcggtactcaacgcatttaaaatattattttcatttaacggatttaaacaagctcgtaaaatatgcaacagttcttttgcagtgatactatcaaaaacgttactacgatctgaaagataaactgatgcaatacctttatcccttaaggctttttgtattttctccgcttgagtaaaactactgactaaaactgcaatattttttgcttttagtggtttgttatctaaaatagcttgattttgtaccgcactttgtagccattgctcaatagataaagcacaattttcagcaagttgtgtgtcattgttgtcagtcaaataacctcttaatgcaggttcaattcttccatttaagcaaaatcggttgggaagaagattcccttgagtgtcataatataatcctttagcaacctgttgaaatggaatttttttatgtaaaaaaggagaattttcttgaaaatcaaaaagataatttatcgtctgaataagaggttgtgtagaacgccaattttcgcccaaactaaatcgatattgtgcttgttccgttgctttcagataggtaaaaatatccgcaccacgaaatttataaatagattgtttaggatccccaatcataataaagcccgtatttttcaccgcacttttaatataaatttgataaaaaatatcatattgctgttgatctgtatcctgaaactcatcaatcatagcaaaaggatattgatggcgaataagttgtgctaatttatctccttgtggttgatataaagcattgcgtaccagacgtaaaagatcatcaaaccccttttgttgatgcgtaagtttataatccattattttacgatttaattcatgaacacaatggtataaaagtacagaaaaattatttgaaatttgagtaacttcattggtcactaagttttccaattcggaaaataaatcatgcgatactaaaggttcttttttatctaattccaattgataaaaatattttgccgcctcaggttgctgaatatcctcgttttctgcccatactcgcattttattaaaacgactttcaaaccaatctttacgccatttttttaaagcgacaagctctcttaatgctttttcattttctaaccaacgttgtttaaattgatgaattttactaagttgaggctcaacttgagtatgtaaaaattgctgcagagaaatctccaataagtgcggtttttgggtatttacttttggcggctgagaaagatatttataaacgtaagataccagttgcttcggcgatcctaattttttgaaaatgaagtttgcgactgacaaaggctgatgataaaaattttcacgccatagctcatttgccagacgttgaattagttcagattcatcactcaccagctccatattaaaatgtacccccgaattaaaggcatattgcattaatactcggcgacaaaaactatgaatagtcgaaacggcggaaatatccaaatttcgttctgctaaagttaaacgatagactgcaagatcgatgtctttaatataaggcagtaattcttgcagaaattgatcttcaagtaatgttttattttgatgttgctgatattgaattaacgcttgttttgtttgataaacacgttcccgaatacgttgctttaactcttgtgttgccatttctgtataagttactaccaaaatttgatcaacttccaatgcctgagaaaaattattttctcccgcttgtaataacaagcgaatataaagagaaacgatggaatgagtttttcctgtaccggcagatgcctcaattaaactgaccgcacttaacggagtagaaataggattaaaaggttgaaagacggatatgcgtaaggaagaatattgatcttgtaagctggtcatgaaattaagcatcttcgatagaacatagaatattgactaatttacctaacctaaactctttttgcaaaccttcaaaccgatgtaaaaataaaacggagcagatcttccgctccgttctcatgttatttgccattcaaactatctaaattacgtaatgcttcaatacgtttttccaatggaggatgacttaagaataaagaagcaagtcccccacgttttccattgatggcaaaagcagctagctgcccctccatttcttgtggctcatgcaacgttttcaaacgttgtaacgctgcaatcattttatgtttacccactaattccgctgaacctgcatcagctttaaattcacgatagcgagaaaaccacattgcaatcatacttgccaatacaccaaacacaagctcaagaaccattgaaatcataaaatatataccttgactggtatttccatcacgatctgtagcaacaacttttgccagcattcgagaaataaaaatgacgaacgtatttaatacgccttgcaacaaagtcatcgttaccatatcaccgcttttaatatggcttacttcgtgagctaaaaccgcttccgcctcatctcttgtcatagcatttagtaatcctgtactcacggcaacaagtgaattcttttttgtcgcacctgttgcaaaggcatttacatccgctgaatgatagatggcaactgtcggcataggtaatcctgctctttctgcctgtgaatgcaccgtttgaagcaaccaatgttccgtttcattacgaggttgctcaataacttgaccatttaccgaacgtaatgccattgattttgacatcagtaaagaaataatagatcccgtaaaaccaaataaagtagcaaaaatcaacaatcccaccgcatcttggcgttgaataccggtcaacgtcaaaataatgttaaaaacaaataaaacggcaaagttagttgctaaaaatagcaaaattctcatcataataaagttcctttacattaaaaattccccgcctatgataaggacaaaatattgaaactcaagggtaaaataaaaaaatttgttaccataaactcatttgtttttgctcaattattgtgggaatactgacatataatccaactaaacgcacagaacgattttgatgtcgttgccaaatttgagttaacagttttacaaaattttcttgcgaacatttcaccgcacttttttctaatgttgttatttggaagtcataaaattttaatttcacgcctattttacaaaaacattctaagggaatagcaggacaagtctttttaattcgtttcaataaaagaggataaaggctattgataacctcaataccttgttcaacttgcaaaatatttttcattaaagttcgttccagcccgatagatttaggttcacgatgagactgcacagggcgttcatctataccttgactaaattgccaaatacgatgtcctattttaccaaatcgatcgattaaaacatgatagtcaaattgttgaatatccgaacaagtttccaatcccatttgctgtaatcgttgcgttgtcacttttcccactcccggaatttttttcagtggaagttgcctaataaacgttgcaacttcttcaggtttaataacaaactgtccattgggcttattctgatctgaagcaattttagccaaaaattttaacggagcaataccggcagatgccgttaatcccgtttcctgagtaatgatttgtctaatttcttctgcaatccacgttgctgagcctgaacatttttgacaatccgttacatccaaataagcctcatctaaagataaaggttcaattaaatccgtataacgcaaaaaaatgtgttggatttgttgcgaaacctgcttatataaaggcatatttacagctaataataccaaatcgggacaaagtttcagtgcttgcgatgttggcattgcactatgtaagccaaactgacgagcaacataattacaagtacttaataccccacgctgattagccaatccgcccacagcaacaggtctatcatacaattccggtttatctcttatttcaatagatgcataaaagcaatccatatcaatatgaataattttacgaaacatcattgttaaaagtgcgattaaaatgttcaaatttgaccgtattctaacatttttactgtataaataaacagtttttgttgcttttcttatttaacatcatttatacctatttttctccaagtaatgtcttttagttatgcttttttgaaagctgtacattttatcctccttttttccgatacggtcctaccagctaaaatttttgacaaaatcactgatttttttgcaaaaaaggcatagaatacaggacgcatttgcaccttaatagaaatgttattaaaatgcggtgttattttgtgctaaaccatttttaggaaaatcagatgagccaagaatttttggattttgaactgcctatcgccgaattagaagcgaaaattgaggctttacgttcagtttcacaacaagatcaacagattaatttagatgatgaaattactcgtttacaaaagaaaagtgcagagctaacgcaaaaaacttttgctaatttagatgcttggcaggtatctcaaatggctcgccaccctaatcgtccttatactttagactatattgaacatatttttacagattttcaaacactggcaggcgatcgtgcttttgctgatgatcaagcaattgtcggtggattggctcgtctagaggaacgtcccgttatgattatcggtcatcaaaaaggacgtagcattaaagaaaaagtaaaacgtaactttggtatgcccgcacctgaaggttatcgcaaagcattacgtttaatgcaaatggcggaacgattcaagttgccaatcattactttcatcgacacgccgggggcttatccgggggtcggtgcagaagaaagaggtcaatctgaagctattgcacgtaatttacgtgaaatgtctatgttaaaagtaccgatcatttgtacagtaattggtgagggcggctcgggaggtgcgcttgctatcggtgttggtgataaaatcaatatgctgcaatacagtacttactccgttatttctccggaaggctgtgcctcgattttatggaaaagtgcagcaaaagcctctacagcagcagaagtaatgggcttaacagcttctcgtttgcacgaattaaaactgattgatagcataattgaagaacccttaggaggtgcacatcgcaactatgacactatgtcaaataatctgaaaaaacgtttgttagccgatcttgccgacttggataaattagatcaagagactttattagatcgccgttacaaacgattaatgagctatggttattgctaattttataaaaatagggcggtcttataccgctcttttctatttatagatatgttatagaggaagaaaaaatgaaaaatattctctcaattcaatctcacgttgtttatggctatgcaggcaataaatcagcaacatttccgatgcagttgctaggcattgatgtttgggcgttaaatacagtgcaattttctaaccatacacaatatggaaaatggaccggcatggtcattcccaaagaacaaattggtgaaattgtacaaggtattgataatattggagaacttcatcaatgtgatgctgtcctgtccggttatatcggctcagcagaacaagtagaagaaattataaaagcctttcataaagtaaaagaacgtaatccaaaagcaatttatttgtgcgatccggtgatgggacatcctgataaaggctgtgttgttgcagatggtgttaaagaaggactgattaaaattgcgatggctcaggcagatattattaccccaaatttagttgaactaagagaattaagcggattagcggttgaaaattttgaacaggctattgaagcagtaaaagtgattctaagtaaaggtccgaaaaaagtattggttaaacatttaagtcgtgttggtaagaatgctgcacaatttgaaatgttattggcaaataatgatggtatttggcatatcagtcgcccattacataatttcaataaagaacctgttggtgtaggtgatttaaccgccggattattccttgcaaacctactgaatggaaaatcggatgttgaagcatttgaacatactgcaaatacagtaaatgacgtaatggaaacaacacataatgcaggcgtctatgaacttcaaactattgccgctcgtgaatggattgttaatccgaaaagccaatataaagcagtaaaaataggttaatcttattaaattgtaggggttattactcctacttttaatatttccaagttcaatagatttcgatcggaatccctatggatttattacaacagttacaaaatcagttaaatcagtttccctctcatactaaacttctactaggatttagtggcggactggactcaacggttttgttatctttattggcaaaactcagaaaaaaacaaccgcacttatccttacgggcaatccatattcatcacggattaagtcaaaatgcagataactgggctattcattgccgacaaatttgtcagcaactggatatttcttttctgtgtgaaaaggtgacaattaatcctcgtaaaggaattgaggctgatgctcgtgaagcccgttatcaagcgattgctaatcatctacaagacaacgaaattcttgttaccgctcatcatcaacaagatcaaacagaaacctttttgttagctttaaaacgtggcagtggcttacagggattgggggcaatgcaaatacagagtgttgtttttaatctgcctatttttcgcccgcttttacattgcacaagacaacaacttgagcaatatgctaaaacagaaaaacttagctggattgaagatgaaagtaatgctgataatcgttatgaacgtaactttttacgtaacgatattttgcctaaacttcgtcagcgttggcaatctattgataatgcggtacaacgtagtgctcaacattgctttgaacagcagcaactgattaatgaattgcttaatgatgaatttaataaaatttacgataaattcgaccgcactttatccattgccaatttcgctacttactcaattttaaagcaaaaagccttactacgaacttggttacaacatctccatattttgatgccttcaacaatacagttggataatattatgagaaatatgattcaagcacaagaggatcgtaatccgacatgtagacttggaaatcaggtcttacgccgttatcaaaaacgtctttatgctacgccgatattacaagatttaagtcatattcgcctagatattcaagctaacgaatgcattaatttaccggataatttaggtgaaatttgtttactaaccaaaaatgagcatttgcaggttacatggcaaaataaacagattttattacccctgacacaggaaaaaatagaaattcgctttcgctattccggtaaagttaaactcccgcaaggatttcatcaagaaatgaaaaaatgttggcaagatcataatgttcccatatggcaacgcactcgtattcccttgattttttatggcaataaatttaaaagtgcggtaggtttttttaataattgtgagtaaaaaaataaccccatcttgatggggctattttaagaaccaatcctatcttaacgccaacttttaaactgattaattaaaccattagttgaactgtcgtgactattgatttgctcatctccaaccagttctggcaaaatgcggttagcaagttgtttacctaattcaactccccattgatcaaaactgtaaatattaaaaattaccccttgtacaaaaattttatgttcgtacatagcaattaatgcacctaacgtgaatggcgtaattttttgcactaaaatgctgtttgtcggtttattaccggtaaaaattttaaacggtacaatatttttcacttcatctaaggactttcctgcttgaataaattcagcttcaacttcttgttgtgttttaccaaaagcgagtgcttctgtttgtgcaaagaaatttgaaagcaatttattatgatgatctgacaacacattatgggtttgtgctggggcaataaaatcacaaggaataatcttcgtcccttgatgaattaattgatagaatgcgtgctgaccgttagtgccaggttctccccaaataataggaccagtttgataattattaatcacttgaccactgcgatctacatatttaccgttagattccatattaccctgttggaaataagctgcaaaacgatgtaaatattggtcataaggtaacatcgcttcagtttcagcacctaagaaattacagttccaaataccaattaacgctaacgtaatcggaatattttgttccattggtgcggtgcggaaatgtttatccatttcatgtgcaccagctaatagttgctcaaaattgtcaaacccaatagaaagtgcaatagaaagtccgattgcagaccataaagaataacgaccgcctacccaatcccaaaattcaaacatattgtgagtatctataccaaacttctccacttcttttacattggttgaaagtgcagcgaaatgcttagctacttggctttcatcttgtgcggctgctaaaaaccatttacgtgcagaaatcgcattagtcatagtttcctgtgttgtgaaagtttttgaagcaactaaaaataaggttgtttccggatttacttttttcaacgtctccgctatatgcgttccatcaacattggaaacaaagtgcatggttaaatgatttttatagggacgtaatgcttccgttaccatataagggcctaaatccgagccgccgataccgatattcaccacatcggtaatcgctttaccggtgtaacctttccaatcaccggaaataacacgttgacaaaaagatttcattttcgccaacactgcatttacttccggcataacatctttaccatctacataaaccggtgtatttgcacaattacgaagtgcggtatgtaatacagcacgattttctgtacgattgatcttttcaccattaaacattgcttcagttgcttcattcaaagcacattctttagctaactgacgtaataaagataatgtttgttgattaatattattttttgaataatccactaaaatttgttcggcaaattttaacgaatagtcattaaatcgagtcggttcttgctcaaaaagttgttgaatagtaacttgatttaagtctttttgatgttgctctaaagctttccacgcattagtttgagttggattaatattttgcatcatttttcctctctatggtttaaaaagttaatcaatatattcgatcaatactctaggtgttaatttagtgataagttcatagcttatcataccgctaattgcagaaatttcctcaataggtaattcctttccccataaaataacttcatcacccaccttatcttgactctcaataccaagatctaccgttaacatatccatcgatacacgcccaacaattggtacttttctgccattaatatagaccggtgtaccttgaggcatatcccgtggataaccatctccatacccaatagctacaacgcctattttggtatctctctcactaatccaacttccaccataccccacaggttcaccttttttatgatttctaatagtaattaatgaagaagttaacgtcataaccggaatcaatccataaacctcagcaggcgtattattcggcgagataccatacataataatacctggacgaatccaatctaaataggcttgctgccaaaacaaaatacctgatgaggcaacaatagatcgctcaccttgtttaccctcagtaacttgtaaaaaacgctctaactgaatttccgtataaccacacatcaattcatctgcccggctaaaatgactcaaaaacccgatttcttttacatttgaacattgaacaagttgctgataaaagtcttctacctgttcaagatctacacctaaacgatgcattcctgtgtcaattttcaaccatactttaattttattcggcaacttggctttcttaagctcataaagctgttcttgattatggataactgtttgaatattattaacagcaataattggcaaatcatcctcggaaaaaaaaccctctaacaataaaataggtttagtaataccttcagcacataaacgtaatgcttccgataatctagccacaccaaaacagtcaaccagatgatgcagagtagaggaaacgaactccaaaccatgtccataagcatttgccttaacaattgcaatgactttgctgtttttggctttttgcttaataacttgaatattatgttttaatgcaacagaactaatcctggctgttggaggtatgacattcattgattcgactctaatcttattttgtataatactgcggtatatttgctaaattatcaaaacgtgaatattgcccctgaaaggctaatttcactgttccaataggtccattacgttgcttaccgataataatttccgcaatgcccttattatcttccgttgtttcgttataaacttcatctcgataaataaacataatcaaatccgcatcttgttcaatggatcccgattcacgcaaatccgagtttataggtcgcctatcccctctgttctccaatgtacgatttaactgagaaagtgcaaccacaggaacttttaattctttcgctaatgcttttaaggaacgagaaatttctgcaatttctaaagtgcggttattttcaaatcctggagctcgcattaattgcaaatagtcaaccatgattaaacttaacccgccattttctcgatacactcgtcttgccctggagcgtaattccgttggtgttaatcccgaagaatcatcaatatacaagttaggtttttgcttaaacatcccaaaggttccggaaattttagcaaaatcttgctgtgttaaattacctgtacggattttaacctgatccactcgagaaagtgaggctaacatacgcatcaaaatctgttcagccggcatctccaagctaaaaaccaaaaccggtttttccgataacatcgcagcattctcacataaattcatagcaaatgttgtcttacccatcgaaggacgagctgcaacaataattaaatcggatttctgtaatccagatgttttttgatccaatgcagtaaaaccggttgaaacaccggtcacaccgttatttgttggtgtagccgccagattttcaattttatcaatagtgttaaaaagaagatttattacattttgcggtccttcattagctgatgttcgtttttccgcaatagaaaatatatcacgctccgcattatccaaaatgtcttttattgcttgcccatttggtttatacgcattttttacaatattatttcccactgaaattaactcacgtaaaattgctttttcacgcacaatttcagcataagtcaaaatattggcagcactcggcgtattgttggacaactctgctaaataagcaaaaccaccgacctcttcactttttccttttgtctttaacacctcatcaagaactaataaatcaacaggggtattctgtgcaaataataatgcaatttcttgaaaaataatccgatgttcaaaagtataaaaatcttcggcaatgatctgatccgctacgctatcccaataacgattatctaatagaatcccacctaaaacggcttgctccgcttcaatggaatgaggaggaatgagggtttgctcaaattttttatctttgatccgtgcagattgatttgaaccggtagttgctttagtcattaaaagaaaaattacctaattagaaattgaaaactgtgctatatgatataccaaatctaagcgagaattaagagagagggaaaaattaatcaaaacaatataagtgataaaaagcaaccgcaccttaaagtgcggttatttttgagaaattttacttcttacgtcgttcaattaatgcttcagacaattgttgtaatacgatttctgtatctgaccaaccaatacaagcatcggtaatactttgtccataggtaagtgcttttgcttcaactaaatcttgacgaccttcaactaaatggctttcaaccatgacaccaaaaatttgttttgaaccattagcaatttgagtacaaacatcagtgcaaacatctaactgttttttaaattgtttactactgttcgcatgactaaaatccaccataacatgcggaatgcgaccggttttttctatatccgcacaaactgtccgaacatcttccgcactataattaggacctttctcacctccacgcaaaataatatgacaatcctcatttccttttgtagacacaattgctgaatgaccgaattttgttacagatagaaaataatgtggtgcttctgccgtacctattgcatcaagagcaatgcgaactccaccgttagttccattcttaaagcccaccgcacatgacaaaccggatgccaattcacgatgaacttgcgattccgttgttcttgctccaatagccccccaactcataaagtccgcaaggtattgcggtgaaatcatatctaaaaattcaccggcagtaggcatttccatatcgttaatatcagataataatttacgtgcaatacgcaaaccatcatttaaagcataactaccatctaaatgaggatcattcactaatcctttccaacccacagttgtacgtggtttttcaaaatacacacgcattataatttccaacgtatcatgatattttatacgcatttctttaatgcgtttagcatactccaacgcagaagcaggatcatgaatagaacaaggtccaataataacgagtaaacgatcatctttttgatgaataatgttatgtgctgccaagcgggctttttttactgttttaatggctacatcacttgcaggaaatttttctaataatgcaatcgggggcaaaacttgctcaacttttgcaattctggtgtcatcatttgcaatacgaatattatttttattcttagccatatactactctctcttactacataaaatttacaatcatagaattaacaatttatatttaatggtattaaacgtaacatttatttttgtactagtaaactaatttctcctagtacgcacttaagacttgtgaaggttgtaatttagccgctcggcttgctggatataaacttgccaataaactcaacatcaaagcgaccactagtaccataagtacatcttgccaatgtaattcgctcggtaaaaaatcaataaaataaattccatctgataataactttttatccagtaaaaattcaataaattgaatcagaccggttaaatttaaactcagtattacccccaatgctattccaactaaacagcctttcatacctgattgcaacccgtaccaaacaaaaatttgtttaataaaacgattattagcccccaatgtacgcataatagcaatatcagcctgtttatcttttactgccataatcaaagttgacacaatattaaagcaggcaacacctatcaccaacaccatcgcaatatacattactgttctaattaactgaatatcgttatacatataaccaaacttgccaatccaatcttgaacttgtaggcgttgcggataatcatataaatattcatacgtcatatttctaaccgcaaaaggatcttgaacttttagctcaaccccagtaatttcatcgggcgtataatccaataatacttgtgcttgcgataagctcatcaacgcataactatgatccaattgcccatctaaacgcaaaatacctgttacttgaatgcgataacggagaggctgagataattgattatcgctattagcaaaagaaattaataacgttacccaatcattttcggatacacctaattctttcgcaatgccatagcctaaaaccaaaccgccatttttctgaaattgttgccagccatcatttaacacaaatttactcaaattactcacttgatcttgtgtaacttgttctattcccctcacttgagctactttcagttttgtgccgttttcaattaatgccgtaaattcaacaaaaggggattgtgctaaaacatttggatcctgctgtaaaagtgcggtaattttttgtcgactttcaatcttgacatttccttgctcttgatacgatataatttcactatgtggaacaacagataaaatacgctgattaagttctcgctcaaaaccgttcatcgcacttaatcctacaatcaacactgccacacctaatgcaattccaatagttgaaaataaagcaattaatgataccaacttatttttagaacgactgtattgataacgccagctaataaaaaatggagtattcatgagttactttccctcaagataccgtcttgcatcactaagcggcgacccaacttttccgctaattgcaaatcatgagttactaataaaaatgcaattttttgttcctgattaagtttttggataagttcaaaaatactttctgttgtcttatgatccaaatttcccgtaggttcatcagccaacacgagttttggattattcaccaacgatctagcaattgcaacacgttgacgctctccgccagaaagtgcggacggtttatgcaaaattctcttagccaatcccaccgcacttagtatattctcagctcgatctttcgcctctgttttatttttgtgactaattaacatcggcatcatcacattttcaagtgcggtaaaatccgccattaaatgatgaaattgatacacaaatcctaaatactgattacgcagtttagctaattcgtcctgtgttgccctttgtagtgattgcccatgaataaaaacttcaccgcttgttggctgatctaatccgcctaacatatgtaaaagagtacttttgccggatccggaacttcctacaatagcaattaattctccttcctgcatggaaaaagacacctcttttaagacttgagtttgaagacttccttcctgataatgctttgtaatattttgacagattaataatctattcatcgtttgctccagttctcttattattcataacgtaatgcttgtgccggctcaattttactcgctcggtaagccggataaattgttgatattaaagataatgttaacgagaaaaataaaattaacgcaatttgataaacgttaatttctgtcggtaaaaaaataccctgaggattaatccactgaataatcttcgctaaattcattgctacaacaacccctaaaccgccacctaacacagcaccgcttgcccctacaaaaaaaccttgcaaaataaaaatattacgcacttgtccttttctcaatcccagtgtttgtaaaatagcaatttcaccttgtttatccaccaccatcaaacttaatgaagtaacaatattagaaaccgccaccacaataattaaactaattagcaagctcatcatattcttttccatgcgaactgcttgaaaaaactcccctttttgactacgccaatctacaattttccattgctcagtagggaaaaacttaggcaattcactaatgaaaaaaggatcttgcaaaaataagcgataaccttgaacttgttcaggtttaatccgcattaagcgtccaatatccgctaaattggcaaaaactgcatagcttgcctgttcagaagaggaagagtaaatatcactaatggtaaataaacgttgtaccggaactcggccaaagggagtatattggctattttccgtcaccatcactcgaactttatcaccaatctgtacgtttaatttttgtgccaatttccaaccgataattaatttaaactcaccgattggaagaagttgcgaaaaatgattttctgaaaactcactcaataaaggatcatcagaaaatttttgcaccccaagaatttgcccggcactgacaccttgtgcagtttgaaacacgacagaagttgtattaatcggcacaactttttgcacaaaatcgggcatgtccggttgcgaggcggtcaaatatatagaattatttttaggcatcaaaatactgtgcggaatattggaaagaacctgttgtttttgatatttttccaagccgttcatcacagacaaaacaataattaacgccataacacctaaaataataccaacggtagcaagcgtcgtaactaattgcccgaagtgatccgcacttttagcccgccaatagcgtaatgcaataaaaagagaaattggaaaggtcatcttataatctataaaattacaaatctatgaattcacgttgcgactacatcaagaaaataaaaacaataaaattggatttattaaaccagtgttttctttgttactgaaaattaatctaacaaacccaatttagtcatttttactgagtaaataaaatcagcttaactaattatttacctgttttgacaaactcttcaatattttgtgcaactttgttcaccaaagtggtcaccgcactatctgatgcccatgcaatatgtggagtaacaatcaagtttggtaaacgagtagctgcctgaataagcggattctctttctcaggcggctctttaaccagtacatcaatagccgctgcggcaatcactttattttccaatgcttcaaccagtgcctgttcatcaactaaagggcctcgtccggtattaattaagtaagccgtcggtttcattaactttaacgtttctgcattaatcaaattttgtgtttgctccgttaaaggacaatgcaaagtcacaatatccgcttgctttaaaacctgttcaaaaggtaaatatcccgaacgaatttccgttgcaccacaacgttcagcgtaaatcacattcattccaagtgcggtcgctaatcgaccaatttctgaacctaaacaacctttacctatcacgcctaaagttgatcctttaacatcggtaatcggataatcaaaatagcaaaattgtttacagtctgcccattttgcacttaactgatctttgtaccaattcattaaactatgttttaaggcaaaaattaaacctaagacatgctcagatacggttaccgaagaatagccggttacattttttactgtaatacccaattctttagctgctattaaatcaacattattcgttcccgttgccgtaatagcgattaattttaacttaggtaattgcaacatcacctcacgactgaaaataaccttactggtaataacaatatcagcctcttttgcacgatctatcaactgatcagcatcggtatattcatattcaatccattgatgctcaaaacttgggcgaggaatagtaatatgttttggaattgccgtactgtctaaaaatacaatttgcatcattttctccttagttaattggaataggccgtgtcaatataccaaagtaataaacataaatatagaaaaaatccgtattcactaaaaatacggatttttcattatgctcatttaatttgacgtatctatttcctcaaaagatttaactagatcatcaatagctttcatttgtgcaacaaaaggttcaagttttgataaaggtaatgccgatggtccatcacactttgcttggtttggattaggatgagattctaagaataatccggctaatccaatcgccataccggaacgagccaattcggttacctgatcacgacgaccaccggaagctgccccaaaaggatcacgacattgtaaagaatgagttacgtcaaaaataacagggcaaccttgcgacacttttttcataatattgaaaccgagcatgtccactactaagttgtcataaccaaaattagtacctcgatcacacaaaatcaccttattatttccacattctgcgattttttccacaatattgcctatttgacctgggcttaaaaattgtggttttttcacattaatcaccgcacctgtacgagccatcgcttcaactaaatcagtttgacgagctaaaaaagccggtagttgaataatatcaacgacttccgctacaggtcggcattgataaatttcatgtacatcagtaatcacttttacaccaaaagtctcttttaattcttggaaaatttttaatccttcttccattcccggaccacgataagaatgaatagaagatcgattagctttgtcaaatgaggccttaaatatatagggtacgcctaatttttgcgtaacttctacatatttttcacaaacttgcatcgccatatcacgactttccaacacattcataccaccgaataaaacaaaaggcttattattgccgatttcaatattgcctaactgaataacttgattttgcataatcatttccttactaatgaatagattcaatttctaattgtaaatattccaattgaggtaataataaaagtgcggtcggatcttccggacatttttctaaaaaatattcaaagtcattcaatgccgcttgcatacaccccatttgagttaataccaccccacgatcacgaatttcataaggatcatcaggatttctggacaagagcatatcaatatattgatatgcctcattatttctaaattcacgaattaacgcatgctttgctaattgacaaaaccgattcgttaattcttgcacatctgcaacttctaatatctccaagcttaattcagtaccaaaaccaaatgctccttcatataacttttttagctgagaatatgtcatatattgaccattccaaggatcaataaaggcgacctcttcatcaacatcagcacgcaaaattaattgcgtaggaaaattgaccggataaatgggcaaattcaaactttcagccaagtataaaactattgctcccagtgttaccggcattcctcttcgttgcgttaacacttgatccaaatataaattctccaacgcaaaataccgttcgggatcacaaaaaaatccccattctccatacatcaactgcaataaatgatgaatttttcttttagtttcccaattagaatcaatttttttacgagcttcacgaaccaaaccgccaatcatgcctcgaatacgccgtatttctttactactattgtcatgcgtaataagataaaaagaggtcatttcatcatataatgctttatgataatacttcattttttcctcttaattgagctaatgttattcgctcattaccgccataatcgttaatcgtttcaacttgtttccacagtttctcggcaaaaaaagaccgcactttttgcccttgctgccagccatgctctactaataaaaaaccttgtttttttaaataattaggagcttgctcaataatatattgcaaatcggcatatccttttttttctgccaccaacgccgtcaaaggctcaaaacgtacatcaccctgatttaaatgctgatcttccgcatcaatataagggggattactgacaattaaatcaaattgtccagttacttgctcaaaccaattactttgcaaaaactgtacttcggtcaaatgattacgcactgcattagtttttgctaatttaacagcatcggcaataacatccagaccaaatatctcaaaatgttgaccgctctttttcagttcatcagccaacgccaaagctatagcacctgtccctgttcctaaatctaaaatacgaatgggggattgagtaaagtcttttgatttcttaagcaattgaatgcaaaccagtgcttgttcaaccaaaatctcagtatctggacgtggaattaaagtatagggagccacctgtaaatttaatgtccaaaattccgtttcacccagcacatacgccattggttcacctttagcacggcgaaccaataattctgtgagttgtttcaattcatcctctgtcaataaggtttctgaaaaagctaaaatcgctgattttgaacgtttagtgacggtttgcaataacaaatttgcatcaactttagcatctaagaaaggatctttagcaacattctcaaataaacgtttttcggcaagttccagccattgttgataattcatttctttagtgaaacttaagttttcttcacaacgatagtcgacataactatatccactaacgaacgtctttccttatttgcaaaagcaacaattgcactaactaaagttaagatacctgttaatgcaaaaagctgttcaataaattcacgcaatacataacgaccaaatgttaagggttgatttgttctatagtctatcacttgtaaatttagccatttctttgctaatgtttgcttagcgttatacatgaggaataattgatatccgatatagaggaaaataaaaatgagacctgcaatctggttcaaaacaatagatccaaacaaaatagccacatagaacaacaatacatttatgagggaagccaaccaacgcttaaatcgactggcataaacgatatccgatacgttattagaatttgcttgtaatttatgatcttcttcaacaataaatttacgctgttcatcattagaattgtttttttcattgaatttttcaacaatcattgtatctccttctcataatcttaagaggaattttttcttcgtcaaaatagattaattttgttcggacaacattgccaactgatctgcttgatattccgtaataattggttgaattagctcgtcaatcttgccattcatcacttcatcaaggcgatataccgttaaattgatacgatgatccgttacacgaccttgcgggtaattgtaagtacgaattttatctgatcgatcgcctgaacctaataaattacgacgagtatccgcttgggcttgagcttgacgttcctgttcagcttgtgcaatacgagaagctaaaacggaaagtgccttcgccttatttttatgttgtgaacgctcatcttgacattccactacaatacccgtcggaatatgcgtaatacgcaccgcagaatccgttgtattaacatgctgaccaccagctcccgaagagcggtaggtatcaatacgcaaatccgacggattaatctccggcatttcattttccggtaattcaggcataacagctacggtacacgcagacgtatgaattctgccctgagattctgtttttggtacacgttgcacacgatgcccaccggactcaaacttcagttgaccatacacgccttcgccattcactttgacaataatttctttatatccgccttgctcactttcatttgcattcaatacttccacacgccaacgtttactttctgcataacgactgtacatgcgaaataaatcaccggcaaaaataccagcttcatcaccgccagttccagcacgaatttctaaataagcattgtattcatcatttggatctttaggtaataacaggatttgtaattgttgctccgcattttcaatttcagcttttgactcttctatttccaattcagccatttctttcatatcaggatcatcaagcaatagttgtgtttcttcaatattgttattcaaccaattccaacgtgcaaaacattttacaacatcttctaattgagcatattcttttgaataagcacggaatttatcttgatcgttaatgacagaagactccccaagcaacgcttcaagttcttcatgtctctcttttaagctctctaatttactaataatactggctttcattctctgaccttacaaaataataatgtaaatttaaatttcaaaacttaatatcaccgaaccattggtatattttatcgtgtattcgagtaccataaaaatcaacaatatttctatcatatttgaaaacagcggtggaaaataaggtaatcactctttcaaaattcacatcaagcaattcaaatagttcactcggcacaacatcttgatatacaaatacattctcaaaatacttttgataatctgttgtttctctagggtgtggttttatcactagcaaacgctcgtcataattttttatgatatgttgataaatggctattttctcttgttctgatattacacgatcttctgataaacactgcgtaaataatatatatttcttcatttttaacgatataagtgaatctaaattaaaagcaaagaaatccaatatgttatgttgttcttgagctgttcttgttttccataaatgctctaatgaaatcagttcaactttatgcctaatgtcacttggtacattttctaaagaggtcaaataaattttctttaccgtcttatgaaaaccaaaaacaggaatattccttgttaaattaatttcatatcttttaggactaaaattcgctatgccatcctcgattaaataaaaatcaaaatatttaagaaaataatctgtccaatctaaatgatcagcaccataaacaggaatacggtcaatcttaaatcgataaaaataaagtttataatagagacgccaaaattttgttattttctttttaatggcaacatagtgcttgattttatactttttatgtaattcaaaatcttcattaaaaacaaataacacttcatctaaatgatatttatttaacatcagaaaaatcaacaacattcttaaactactgacaataacaattgctttgatttttatattatacttcatgatattcaactattttggctctaaatcttagattattacccaactccgaaaacagaaaattcaattcgaggctgccttagaattacctaaaacagcctctatataataaccataatagcagagctacattacagaaacatttaaagtggagccaccaacaatacgaactcgagctcccggcactaaagttgcatcatacttttgcacaacaacaatttcttgtccattgtcttttctgataacaagttccaacgcattaatctgacttgctttttcttctactttactaccaattaccgctccggcaatagcaccaactgctgcagcgactgcctgtccggtaccaccgcctatactagatcccactattccacctaaagcaccaccaccaacagtcccaatcacaccttggttatcgccttgaattttaaccggacggattgattcgatgataccataactgattgaacgagctgatttagcttgtgtgccactatatacattaccactgtatatatcttcattggcacacccagctaatcccaaactaagtaaaatagctaatgataaagtcatttttttcataatagttaacctctcttttttgattaatttttagatgttctagaaagccaagaacttgatcttttacgagaaatatttgttactgttataccatcgtcattgtgagacacctctacacaagagcctacaactaaatgagaatcgtaagaatgacttaatacgatctccttaattcctccctcttgctgtttgcaatcatttttacgaatagttaattttaaattatttcctttttgagcagcgaacaaaatttcgcccttatacacattatcattttttgtagatgagcaagctgctaatcctaaaaaacctaataataaagtgaatgctaatgttacttttttcatcgaatctaaccctcaattatctttttgatatgatacgggtgaacttttatgcaagtatgattttctagttgattaacaaaactcactgcaatagacgggttaggtaattgctcgccatccgccttaggttcacttactttaactttcaaattagccaattcgtcccataaaaattgttgtcttatacgtgtaacccattcatcaacagtttcattcacttcaaatggaattacaacttcaatatgctcccagttttccactggatacactttatctttagggaacggtaattcaataatatcaataaactgatccgaaaaacgtatcggattatcaagttgaattaaataaataactctcccgtttacaatattaccgctcagaattgtaccgcactttaacagcaaagtcagccaatcctccgcagatttacgtttatttactctcaaggcaatatgatcaatttcaacacgatctaaccgtaattgcatgaaatgggctaattcaataatttttctttcaaattgttcaaactcatctaatgagatattagattgccgaaacaaagaatgattttggttaaaaatctgcattttttattgctttatcttttctgaataaggaaagagcggtatcataacgcattattttcacaaatcaattattaggtatatcagtgaatattcagtctattttatctaacaaaatcaaacaagcgatgcgtcaagccggtgcagatgaacaatgtgatgctttagtgaaaccatccggtaaacctcagtttggcgattatcaagctaatggaattatggcaacagctaaaaaactgggtttaaatccccgtgattttgctcaaaaagtactcgatctcattgatttaaaaaatattgccgaaaaaatggaaattgcaggccccggatttattaatatcttcttagataaaaattggttggcagaaaatattcaagttaccctacaggataagaaattaggcgttacagtcgaagaaattcaaaccatcgttgtagattattcctcaccaaatgtagcaaaagaaatgcacgttggacatttgcgttcaaccattattggcgatgctgtagttcgtacattggaatttttagggcataacgttattcgagcgaaccatgttggtgactggggtacacaattcggtatgcttattgcctatttggaaaaaatggaaaatgaacatgcttcagcaatggaactggcagatttggaagccttctatcgtgctgctaaagaacattatgataatgatgaaacctttgcagaaaaagcacgtaattacgtggtaaagctacaaaatggtgatgcttattgtcgcacaatgtggaagaaacttgttgatattactatgcaacaaaatcaacgtaattatgatcgcttgaatgtgaccttaaccccaaatgatgtaatgggggaaagtctgtataatccaatgctacctgaaatagttgcagatctaaaagcacaaggtttagccgttgaagatgaaggtgcacaagttgtttacctcgaagaatttaaaaataaagatggtgatccgatgggggttatcgtgcagaaaaaagatggcggtttcctctacacaacaacagatattgcagcggctaaatatcgttatcatacattaaaagcagatcgtgctttggtgttttccgacacacgtcaaagccaacatatgcaacaagcatggttgattactagaaaagccggttatgtgccggacagtttccagctggaacataaaaatttcggtatgatgttaggtaaagacggaaaaccgtttaaaactcgctccggtggaacggttaaactgacagatttattagatgaagcgattgaacgtgcggataaattaatttcaggaaaaagtaccgctctttcaagcaaagaaaaagcggctgtgatagaggctgtgggtatcggttcagtcaaatatgcggatctttctaaaaatcggacaaccgactatgtatttgattgggatatcatgttaagttttgaaggaaataccgcaccttatatgcaatatgcttatactcgtattcgttctattttcaacaaaaccgatattagcgaagaacaacttcaccctgcaaagatccagctcacagatgaaaaagagcgtttacttgcaattaaattgctacaatttgaagaaacagtacaaattgtaggcaaagaaggaacaccgcatattctatgtgcctacttgtatgagttagccggtttattctctagtttctacgagcattgccctatcttgaataatgataatgaaaacgtgaaattaagccgtttaaaactcgccttactcaccgaaaaaaccttaaaacaaggtttggatttactcggtataaaaacagtggaaaaaatgtagttcagatatttccattattggttcgtataaaaaaggcaacatccgttgccttttctgtaggttattaatttgctcatggtgtcaacaaagttcttaaaactttaccaatatcagccaaacttcttaccgttttcacgccggctttttccaaagcgacaattttttcctctgccgttccttttccgccactaataattgctcctgcatgtcccattcgtttgcctttcggagcggttactccggcaatataagccacaacaggtttagttacatgtttatggataaaatcggctgcttcttcctccgcacttccaccaatttcaccaatcatcactatcgcatcagtttcaggatctgcttggaataatttcaaaatatcaataaaactggaaccggggataggatctcctccaatccctacacaagtggattgtccaaacccttcatccgttgtttgttttactgcctcataagttaacgtgccggaacgagaaacaattccgatacgcccttttttatgaatatttcctggcataatccccattttgcattcctctggtgtaataacaccgggacaatttggaccaatcatcacgacatcactttgctgtaatttttttttcacctccaacatatccaacgttggaataccttctgtgatgcaaacaataaacttaatgcccccatcaattgcttctaaaatagcatctttacaaaaaggtgccggaacataaatcattgttgcggtagcaccagttttctccactgcctcacgaacagtattaaaaacaggcaatcctaaatgcaacgaaccactttttcccggggaaacccctccaactaattgagtgccataagctaaggcttgttcacaatgaaacgtgccttgtttaccagtaaaaccttgacaaatcactttggtatttttgttaattaaaattgccattattcactctcctttgctgcattaactgcttgttccgctgcttcagttaagctgtttacagcaattaaattcaagttactttgtgctaaaatttcacgtcctaagtccgcatttgttccttccaaacgcacaataactggaacactcacaccaatttcattgattgcggaaacaattcctttagcgattaaatcacaacgcacaataccgccaaaaatattcactaatacggctttaaccgcactgtccgttaaaataattttgaatgcttccataacccgttcttttgttgctccaccaccgacatcaaggaaatttgctggtcgtccgccatgtaatttaataatatccatcgttcccatggctaaaccggcaccattgaccatacaaccaatattcccatctaacgcaacgtaatttaaattccacttttcagcctcagcctcacgaggatcttcttgcgttaaatcacgcatagaaaacaagtcggggtgacgatacaacgcattatcatcaaccacaacttttgcatctaagcaaaataattcatcgttttttaaaataaccaatgggttgatttccagtagggataaatctttttcaacaaataatttggcaagttggcaaaaaatttggctgaattgctgaatttgtttccctgataatcctaatttaaatgccaattctcgcccttgatatggcatcgctccaaccaaaggatcgatagttaccctatgcaataagtgcggtgttttttctgctacttcttctatatccataccgccttcacttgatgccataaagacaatacgttgagagctacggtcaataattgcactcaagtacaattctttttgaatttccgcacagggttcaagataaatttgatgaatcggctgtccctgttcatttgtttgaacggtaactaaacgctgtcctaaaaacttagtaaaaaacgaccgcacttcttgtgctgatttaaccacttttactccaccagctttaccacgtccaccggcatggatttgacattttgcaatccattgagaacctgataatttctcaatcgcacttaacgcctgttcaacattttcacaaacataacctttagttacaggtaaaccataatctgcaaaaagttttttactctgatactcatgtaaattcatatcgtccccttattgatacgtttcaataccgcacttttagattatcggtacttctaaatttccagtagcaagcgagtcggatcttccagcaagtccttcactgtcaccaagaaaccgacgctttcacgtccatcgattaaacggtgatcatagcttagtgccaaatacatcattgggcgaataaccacttcaccattaaccgcaacgggacgatctttaatcgcatgcatacccaaaatcgcactttgtggcggatttataataggtgttgacattaaagaaccaaaaacgccaccgttagtaatagtaaaattcccccccgttaaatcttcaacggtcaattttccatcacgacctttttccgccaacaatttaatttctttttcaatatctgccatacttaatttatcgcaattacgtacaaccggcgttaccaaacctcgaggtgtggaaacagcaatactaatatcaaaataattgtggtaaacaatatcatcaccatcaatagatgcgttaatctctggatagcgttttagtgcttcaaccaccgctttgatataaaaagacataaatcctaagcgtgcaccatgttgtttctcaaatttttctgcataacgcttgcgtaaattcataatcggctgcatatccacttcattaaatgtcgtcagcattgcagtagtattttttgcttccagtaaacgctctgcgatacgcttacgtaaacgtgtcattggtacacgtttttcattgcgatgatcaattttcaacccagttgcaatagactgagatgcttgtgccgtttctgtttgttgtactttttgcttaaccactaacgctatatcttcacgagtaattcgaccacctacacctgtacctttaatttcatcagcatttaattcatgctccgctaacaaacgacgaacagccggactcagtacatcgctacttgcatcagtattcaaattagccgaatgacgatctgccggtgttttttccacattctgtacagttgattttgtaacttctccaatacctgccgaagcggatactttacccaacaattgtttactcacgacagttgaaccttccggttgtaaaatagtttcaagcactccatcactaagtgcgggaatttccaacacaattttatcagtttcaatttccactaaaacttcatcacattttaccgcatcacccacgttcttatgccacgttacaacggttgcatccgccacagattcagggagatccggagtaataatatcgaaattgctcatattttttcctcctattcatatttcgcttaaaattagatatatatccgttaattattgaaaatttttccaatactttaacctggcaaaattacgctaatgcctcagttaccaaagctcgttgttgctcattatgtaaagataaatagcccactgccggtgaagctgaagctggacgaccaacataacgcaacttaccatgtggcggtaacgacgtccaaaaattatgctgacaacaataccaggccccttgatttaaaggttcttcttgacaccaaacataatcagtcacatgagaataaggttctaaagcctctttcatttcttcatgtggatatggataaagttgctcaatacgaataatagcaacatccatttgattattttctcggcgttgttccaataaatcataataaacttttccggaacacatcacgacacgacgaactttttgaggatcaatcgcatcaatttccgcaatcacattttgatattttccatgtattaattcttccatagtagatactacaagcggacggcgtaacaatgattttggagtaataacaactaatggccgacgcactttacgcagcatttgacgacgtaataaatgataaatttgtgccggagtagaaggtacacatacttgcatgttttgctgtgcacagagttgcaaataacgctccaagcgagcagaagaatgttctggaccttgcccttcatatccatgtggcaacaacatcactaaaccacacatacgcccccatttttgctcgccggaactaataaattgatcgatcacaacttgtgcaacattcgcaaaatcaccaaattgtgcctcccaaatagttaatgtccgtggtgccgctgttgcgtaaccatattcataagctaaaacagcttcttctgataatacagaatcccaaacttcaaaacgcccttgttgagcatgtaattgagttaatggaatatacaacgtcgcatctttttgattgtgtaatactgaatggcgatgaaagaaagtaccacgtcccgcatcctcaccagataaacgaacattatatccctcatcaagcaaggtcgcataagccattgtttcagccataccccaatcaaataatttatcgccttgtgccattgataaacgatcatcgtaaagttttttcactcgaggatgtaatgaatgcgaacttggataatcacatactttcttagctaatccgacaaaacgctcagcatcaaaggaaccatcatactcagtccattcttgcgttaaatacttagtccaatctttcgtttcaatatccgcttcacgccattccggtacaacacaacctccattatccaaggcatctcgatatttatttgctaattcaattgcatatgcttcatcaatgataccttcagtaactaggcggttcgtataaactttcgggggtgttggatgcttacggatacgttcatacataagcggttgagtaacagcaggttcatctgcttcattatgcccatgtcgacgatatgacaccaaatcaataaaaatatcacgcttaaattttgctctaaattcaaccgccattcgtgcagcataagcaacagcttctggatcatcaccatttacatggataaccggtgcctcaatcatcttcgctatatcagtacaatattctgttgaacgtgtatcctgtagatttgaagtggtaaaaccaatttgattattaatcaccacacgaattgtcccaccaactgtatagcctctcacttctgacatattcagtgtctcttgaacaatgccctgccctgcaaccgcactatctccatgcaccgtaattggtaacacttgagaacgttcaacgtcctgaatacgattttgtcttgctcgcacagaacctaagacgacaggatttacaatttctaagtgggaaggattaaatgccaacgctaaatgtacaatgccatcgtcagtcataaaatcagatgaaaatccttgatggtatttaacatcccccgtcccactgccactatgcttaccggcaaactcatcgaataattctgaaggctttttacccaacacattaaccaatagattcaagcgacctctatgtgccatgcccatcacaatttctttcacaccatttctgctactatgacgaatcatttctttcattaacagtataaaagcatcgctaccttctaaagaaaagcgtttcgctccagggaatttcgcccctaaataacgttctaatccatctgctgcaattaattcttctaaaaatttcagttgttcttctcgggtgaacagcggtttatctaataacctctcaactttgcgttgcaaccacgtacgagcgtcaagatcgttaacgtgcataaattctaaaccaatcgtactgcaataagtctttttcaacgaatcggctaaatcacgtaacgaaatttgctccttgttataaacataaccgccaatatcaaaaacttcatctaaatcattatcagaaaaaccataaaacttataatcaagcgttggtgcctccatacgttgccacatttttaacggatccaaatccgcatgtagatgccctcggttacgatgcccatttatccatttaagcacattaaccaatctcgcactaacattaggatctatcacccccactccattttgagaagtatcacgtgctaaacgtttaaaataatcacggacttttgaatgaggctgctcaagtgcgttctgttttggaagagaattgaaaacttgttgccaactttcgtcaacagcttgagggttatcaagataatcttcataaagatcctcgacataagactggttcgcaccacctaaagcactggatgccaaccattcactgatagggctattttttttcattatgaccacctaacttgattattgatagcaatttacagtgtaattttttccattatacatagatttagccataaacaatctatttatttgataagctatatcaatttcagctggaaattaaaaatcaaattacctatctaagcaataaaaaagttaaaaagttgttaataattttttatttttttgatctacatctcatttttaaacatccaacaccttatttgtaaaaataatgtaaaatttatgcagacagtaacaaaattaaacgttatattgaaaacatacacaaatattcaacatcttactttctttataaacttttaaactctcaagggggaatgtcttatgtctaaattaacagcaaaacttacacttagtgacggacgtgaatttgatttaaatgttcaacaaggaacgcttggatacgatgctgttgacgttcaaccgttagttaaaaataaattatttacttttgaccccggatttatgtcaactgcatcttgcgtttccgaaatcacctatatagatggtgataacggcatactgttacatcgtggttatcctattgcggatcttgctaaaaatgcggattatttagaagttgctcatctactgttatttggagaacgcccgaataaagaagaatatgccaactttataaagttggtcaaaaatcatactttagtacatgagcaaatttctcgcttcttccatggattccgtagagactctcaccctatggcgattatgtgcggggtaagcggtgccttagcagctttctatcatgattccttggatattaatgatattgaacaccgagaattaacagcaattcgtttattagcgaaaatgccaacgcttgcggcgatgtgttataaatattctattggacaaccttttatgttcccattaaacaaactttcttatgcaggaaattttttatatatgatgttcgcaacgccttgtgaaccttatgaagttaaccctgtattagaaaaagcgatggatagaattttcattttgcatgcagatcatgaacaaaatgcctcaacatctacagtgcgtaccgctgcttcgtccggagcaaacccttttgcttgtatcgctgcaggaattgcctctctttggggaccggctcatgggggagcaaatgaagcttgtattaacatgctagaagaaatcggttctgttgatcgtattcctgaatacattgcacgagcaaaagataaaaacgatcctttcagattaatgggattcggacatcgagtttataaaaattacgatcctcgagctaaagtgatgcgtcaaacttgccatgaagtattaaaagaattaaacattcagacaccgctctttgacgttgctatggaattagaacgtattgcgttaaatgatccttactttatcgatcataaactgtatccaaatgtcgatttttattcaggaattatcttgaaagcaataggtattccgacatcaatgtttactgttattttcgctttagctagaacagtaggttggattgctcattggaaagaaatgtttaaacctggcaatatgaagattgtacgccctcgtcaattatacaaaggacatacagaacgtaactttgatgccattgaaaaataatttctgtcagagttaaagtgaagctcgtctctttttgaatggcgagcttgattttttgtaccttattctatttttatcaaaatttacaataaatcgtggtaaaattagactaattaatcataatcgggaatttttctatggcatacactaccttttcacaaactaaaaataatcaattattggaacctatgttttttggtcaaaacgtcaatgttgcccgttatgaccaacaaaaatatgaaacctttgagaaattaattgaaaagcaactctctttcttctggcgaccggaagaagtcgatgtatcacaagaccgcattgattatcaagcactacctgaacatgagaaacacatctttattagtaatctaaaatatcagacattattagattctatccaaggtcgtagccccaatgttgccttactgccattagtttccattccggaattggaaacatggatcgaaacttggacattctcagaaacgattcattcccgttcttatacacatattattcgtaatatcgtaaatgatccgtcaatcgtttttgacgatattgtcacaaacgaagaaattatcaaacgtgcaagagatatttcttcttactatgatgatctaatccgtgacagtcaactttacggattatatggcgagggtacttatacagtggatggtaaagcctgtaaagtcactttacgcaacttaaaacgccaactttatctctgtttaatgagtgtaaatgcgttagaagcaatccgcttttatgtttcctttgcttgctctttcgcttttgctgaacgcaaattaatggaaggtaatgcaaaaattattaaatttattgcccgtgatgaagcactgcatttgacaggcactcagcatatcctcaacatcatggcggcgggacaagatgatcctgaaatggctgaaatcgctgaagaatgtaaacaagaggcttatgagttattcgttgcagcggcggaacaagaaaaggaatgggctgattatctctttaaagatggctcaatgatcggattaaataaagatattcttgtgcaatatgtggaatatatcacaaacattcgtatgcaagctgtgggcttgccattgcccttccaagcacgttcaaacccaattccttggataaacgcttggttagtatcggataatgttcaagttgctccacaagaagttgaagtcagttcttatcttgtcggacaaattgatgccaaagtagatacaaatgacttcggcgatttcgatctataaaacacctataaaatcaaccgcactttgacctaggttaaaagtgcggttgatttttactaaaaatgatgaagatttatcaagtttatatcagcaattaccggcaaacgcttacccatgccaacgaaatgcctttattggaaaaattagaaaaaaacggcattatacatgaatatcaatgtcgctcaggttattgtggttcatgtcgggtaaaactacaaaaaggcaaagtgtcttataaagaacagccccttgcctttcttaatcaaaatgaaatattactttgttgttgccaattggaagatgatatagaaatcgaactctaatctatacacacgcaaaaatgcgacttccaactcacttatctcttaaaaaatatttactggttagcgttttccttcgttgttacaaacaatagccaatatcctactacagccgatacactagaaccaaacaagatacctaatcgtgcataagcggttaagtgtccatctcccccaccaaaagcaagactggctaaaaacatcgacatagtaaaccctataccacaaagtaccgaaactgcaaatatctgtttaaaattaataccttcaggtagttttgctatatgcagtttcactgataagtagctaaataaaaacacaccaatcggcttacctaacaataaccccaacgtaacacccagtgttaatggtgaagttaatgcttccatacccaaaccagacaaaggaataccagcattacaaaaagcaaagagcggtaaaattaaaaatgagctccaaggtgcaatagcatgttccatttcaactaaaggttcgctgttatttttacctttcagaggtacacaaaaacctataatgacaccggctaatgtcgcatgcacacctgatttcaatacagatacccaaaggataatcccaacgacaacataagcgattaaatttgatactttgaaacgatttaacaaaattaagccaacaatagcaatacttgctaaaatcaacgcttttgtacttaaatcatgtgagaaaaataaagcaatcacaataattgcacctaaatcatcaataatagccaatgctaataaaaatacttttaaagcaagaggtactcgagtacctagcaacactaatacaccaatagcaaaagcaatatcggtcgccattggaatggcccaaccgccgtgataatcaggaacaccttgatttacgagccaatacactaaagctggtacaatcattccgccacaagccgcaattgccggaaaaatagccttttgatagctggaaatcgcaccaatcaacatctcacgtttcacttccaagccgacaagaacaaagaaaatcgccataaatccgtcatttacccacattaataacggtttattaagttcaacgatagatccgaattgaataatcaccggagcattcagaaaactaaagtaatgatctcttaacggagaattggcaaatatcaccgcccctacagaaaaaaccaataacaggattcctccggcggcctccatttgtaaaaattgacgaatacattcccgaattttttcagtcattattttcattattacttcctttgcataactaaaaacgcatataacaagtttttatcacgaacttttattgagggtcaaggcaaatcaaacaattttttctattggtaaaaaaaacacaacaaagttcacaataatattcaacaaatttaacaaaactttatacaaaaacaaatttactcaacacatttaaagctgttgatacactctcaacgcatacgcatcggacattcccgcaatataatcgcaaataattcgcttacgatctgtttctgttgctttttgccaacgcattgctgtattacgaggcagtaaacgcaacggatcactgtcaaaaatttgaaacatttcagtaagcattctttgccctttatattcgacacgttgtgtatcaacatgtttaatcacatactcccatacgaagtgtttaaaaatagttaaaacttcaataacttcatcaggtaattcggcgttataacgtaataaaggctcggaaaaaccattatttattttccaacgtacatgggtaataaaataattcaccaatgcaccgatggcatttttacgctcatagtgtaattccgaaaaaagtttttgactgagcgaggatatagtctgaacaatccattcagaacgacattctgttaatttttctactgcactttgccattgctgaaacgttaccacgccaacaacaatcgcatcttctaaatcatgtaccgcataagcaatatcatctgcaagctccataatactgcaatccaaagatttataacgggttttcaaaacctcatcaggacgagtacgctcttttttatattgcccgaataaagtgcggtcattttccgataagggtccaagtaaccattcaaacattttcaaatcatcacgaaaaatcccttttcccggtttccacgctgaaatcttcacatatttagaatcaacattatcgacaattaccccttgatgatattgtggggaagaacgatctaaaatcgtaggatatttaacaatgcccaataacgttcgacgagttaaattcattcctgcattaggcgtataaggctcaagcttagttaataaacgaaacgtttgtgcatttccctcaaatcccccatgatgacgcatcatataattcaaggcgacttctccgccatgtccaaagggcggatgaccgatatcatgagcaaaacaaaggctttcaatgaggtcattagacggcagtattaatttaagttgtttttgcaaatctgctcgatcttccttgagctgttgagctaaataaataaaactatcaataagtttcatttgtgccacaatactgctaccaatttgagcgacctcaagcgaatgggttaaacgagtgcggtaaaaatcattttcgcctatagcgtgaatttgtgtttttgcttgtaaacaacggaaagccgcactatgcaatattctcccacgatcacgacgaaaaggcggacgatgatctttctctctcggcggatcggcaagaaagcgttcttgccaagatgaattaatttgcaatttcatatttacctctcaaaaacaagcaaagtccacgtaattcatctcattatacaactcaacgtcaacaaaaataataaaatttatagcttgatttacttcttttattcgttttgttacgttttttcggtaaaatagacgaaattatcttgaacaacatcatcaatatgtggaaaaaaatcttttttattttatttttttgtgccatttctagtgtttcagccaaaaatccccgcattcttccttgttatgtagtgaaaattagtgatggcgatacatttacctgctcacttcgcaataacaaaaaagtaaaagtgcgtttacaagaaattgacgcaccggaaaaaggacagccgtttggtaaaaaagcccaacactatcttacaaagttaatttataaaaaaaacgtaaaattgcatgtgtcaagctatgaccgttatcaacgaatgctcgcaacggtttataactcacaaggaaaaaatattaatttagcgatggtaaatgcaggttttgcttgggcatatcaacaatatttaaaagatccgcagtatctacaagcacaaaaatacgcacaacgtaaacgtcttggcttatggcaagatcctcatcctgtgtatccacatcaatggcgtaaacaaaaaaagcaaaagataaaaaaatatgatttttgatccaacattatttcgccagcaatttcctttttttcaccaaaaaaatggtatcacttatctagacagtgcggcgaccaccttaaaaccgcaagttctccttgacgcaacgcagcatttttatgcttctgccggctccgtacatcgaagccaatatgatgcaaaacagaccgcactttttgaacaagcgagaaagcaggtgcaaaaactgatcaacgctgaaagtgaagaaaccgttatttggacatccggcaccacacaaagcatcaacattgtcgcctacggcttaatggcacaactttccccaaacgatgaaattatcattagcgaagcggaacatcatgcaaattttgttacttggcaacaaattgctaaaaagtgcggtgcaacattaattattttaccgttgcaagataatttactcattgatcaacaaattctacaaaaatccttaaacaaaaaaacgaaattagtcgccttaaatgtgatctccaatgtaacaggaacacaacaaccgctgacacagcttatccccatcatacgagaaaaaagcagagccttgattttattagattgtgcacaagccattaaccatcaaaccattgatcttcaaaggcttgatgcagattttatcgttttttccgcacataaaatttacggaccgacagggttgggtgtattaagtggaaaacgttctgctttagaacgattacaacccagttttttcggcggaaaaatggttgaacaggtttcaaaacaagaaactgtttttgcctctttaccttatcgcctcgaaagcggcacgcctaatattgctggcgtaatcggttttggtgcggtattaaattggctggaacaatggaatatcacacaaggggaacaatttgccgtgcaactggcggaaaaaacaaaagagcggttaaaaaattatcctcattgtcgcctatttaattcgccacacccaagcacatttgtttgctttacattcaccacaatcgccacatcggatattgcgaccctacttgcagaacaacatattgccttgcgtagtggcgaacattgtgcaaaaccctatttacagcgtctaggacaaaaaagcaccttacgcctctctttcgccccttacaataaccaagaagatattgaactgttttttagtgcattggataaaagtttggagttattggcatgattgaacaaatcaaacaagcgaaaaattgggaagaacgttatcgcttaatcattttggcaggaaaaaatctccgccaaccgacagaacagcaattggctgaaatggaaatcattcaaggttgcgaagtcaaagtatggtttaaatgcttacttaaaacagaccgcacttttgaatgccacgcttatagcgaagcaagaattatgaatggcttattatggatattattgcaagaaatgaacggcaaacaagcgactcaattggcagaatttgatttaatccaatatttcgatgaactcggcattgcccaacgtttaaccgatacaagacttaacggcttaaaacaaattgagcaaaagataaagttaatgccttaagacggtatacaatactactcaaacgttaacattcacatcgaaaaatacaaatttgttgatgaaaatctatgcttatgcaactcatctccttgaagaagagaaaaaatagacgttaggtaagatttacaaggcaaaaggcttttaaattacttttttacttgttttttgctttgtaaatactctcaataaacttgctaaatttattttaattactcaaaatatacttaatgaggtgtgacttgttttgatgaaaaagcaaacaagtcaagagatgaaattaaagcagttattgatgaaattttagggagtgaataatgaaattaccaatgcaatctaaagaagcaactaagtttgttaaagaaacgaataatggcgatttaaagcctaaatctaaagtttcctctattcttctctccgagaaacaaaatcaatttgtaaaagattacgttcgacggtgaagatattagcccatttcttaaagaatggattgagctatactctgaacacttgaaactaaaaatgaaaaatatattgctgcttgtgctgattcattatgccaagcataatactaaatttgatgttgatagtattttatagctttaaattgcttgcaaaatacttttattttacttttatattactttttatcttttagcaaagatgaaattatgaggagaaaatttatgattactgaagaagagaaattaagtagaaaaaaagctgttcaatctgcgattgataataatcgtttagaggggttagagcctagtaaagtttttattgatattgctcaaaattgggtcaatggaaatttgactaatgatgaatttggaagaaaagtttatgaaatacacgggcttcgattcccacattgatgaaaataaagtcttaaaaaatcattttgggattaaagatcaaaataagctagatcaaatagaaagagatattacctcttacaaagaatctattcttaacgataatccaataaaaggaaaatttgaccttaagcatttacaagatattcacaaacatttatttagcgatatttatccttttgcaggaaaaattagagacggctatttgcaaaaaggggagcaagatttcactatgggatatagaattgttccacaagctgaaaaattgtttagtgagctaaaaagtgagaatttcctaaaaaatactgaacccgataagatggctggacgcttagcttattatatgggcgaaataaacgctatacacccttttagggagggcaatgggagaactcaaaggatatttatttctcaattagcaaaagaagcaggttttgaattaaactttaataaagttagtcaaggtgaaatgataaaggcttctattcaggctcatagatgtgattatacagccttagaatctattattgaaagggggttgaaacctcttttttcaaaagttcttgatgggcttgctactcataaaccaacagtaaatcaggcttaatgtggcattctcatcacctttgctacagtaggggcgaatcacattcgccccatgacatcaacccgaacggagaataaaatacattaaarggcggatgtaatctgcccctccccttgtttctttaaattgccatcaatgcggatatttaagtttgaagttgtcataatttaagctcacattgtagataaaaagcaaattacattacatttacatttcattataatttaaatataattagaacccactttaaatagcgtttaaatgtcattaactttggaggtttattatggattatacaaattttaatatgcgacttgataacgacttgcgtggacgggcttatcctattttggagcagtatggattgacgccaagtcaagcggtaagaatgttttttaatcagattgcacaaaccggtaaaatacccttgtcgtttgattgggcggaaaatcaaactttaaccccaaaagcagccgcacggttacgccaaactgagcaggaattcgccaatggcgaatttgaacgcttttatagcctaaatgaactcaatcaagcgataaaggagatctcgcatggctaaacgcaaatttgatatggcaaaatcttttaaacgtgatttgagaaaacattacttggctttagtcggcgaagcatgggcagagatttcaaactgtcttttgaatgacttgccaattcctgaaaagtatcaagatcacccgcttaaaggcgataaatcaggctttcgagactgccatgtcaaaccggatttagtgttgatatacaaaatcgttgatgatgttgtggagttacattaccttgatagccatagcgaaatttttggctagcctaccgctctttgttacaaaaatgtcaaaaaaaaccgctccgaagagcggttaaatttttgaggttttattatatattatatattagaagtaaacacgtaagcctgctgcgtaaaaactttctcttacgtttttatcttttgtaggcgctttaacacggctattagcaaattctgcgtatgcttttagatttttgttaaaggcatagtcagcaccgacgataaacacgttttgtactgctttttgatgctcttctannnnnnnnnnnnnnnnnnnnnnnnnnnnnnnnnnnnnnnnnnnnnnnnnnnnnnnnnnnnnnnnnnnnntagcacttctaaagccattacgttgccattgagtatatacattcaagacatccggtaatacttcatattttgcacccactaaaagataacgtgcagaacctacaaaaagctttttattttcagattgatacactgtttgaccatattcaacgcccaacgatgctggaccgaattctacttgcgttgctaaacgccaagctttatgttgattatcagttctagacttaatcacacctaccacatcattgttattacgaaccgtataaccggcattggcatttaccttaatatcgccgaaattaccggcatagaatgcagaaactccgtaagtattttttaacttaatatgttttttgtctgaatcctttcctttaatatcttttttatgtgcttcaccgaaaccataatcaacaccaaaacctaaagtttgaccttccgctaattggatatctgctgtacggaaagacaccactttatcaccagaagtaagcaagttgttgttgccgccaaagatataggtatgatcatttaattgaacatcatccgcagtggtattttgtttaccgaaagttactttaccgatatcgttatgttttaagcctaaccataatttagaaagtttgatatcgttaaaagatgtatctgcttttgaagcgtcacctaacccgaaacgaaccgcaccgattgcttttaagccgttttgtacttcatgctccgctttaaattccacacgagatccgttattacgtaaatcggtacgttgagcatcaccgaatttacctaacattacatcaacacgaccgccaacttctactttggtaccgttttgattataaacagttgttgcgtttgctgatgccgcaactgccgctaccgctaatgctactaatgtctttttcataataaaattcctttcaaatttaaattattttactactgaattgaacctttccatatatgaaaagtccaagccaacttttaaaaaaaagcgagcctatattggcaaagaaaccgtttacagtcaactaaatttaataaaaaaatgctaaatttagtgatctaaatcacactttttgaataatttttgaactttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttacctctctcatcgcttaaatattcacttttttcgagcaaataccatgcctttgctttattctttttcttgaactatacggctgttaaccgtataatttaggactattttaacaattaaagagggcgtatagaaatgagaacacaagtaacaaaagcaagattggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgacattaagcgatcaggctttactcattgacaatctcagtaaaccgtttgagcctactcagtcaatgaaaaatgcacttgatgtgtatgaagaatatctttccgttgcggggaaaaataatgataaannnnnnnnnnnnnnnnnnnnnnnnnnnnnnnnnnnnnnnnnnnnnnnnnnnnnnnnnntcatttttttgctcagttgaacctttagaaaactactttcataggcatgtttctcaagatgtaaaaaaagggcttgcaaagtgttttgtgcttataaacgaacaacaatccaggattgttggctgttacactttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttttagtggtattcagttccgacaatcggtttgattttttcccatttccgacaagatgggcaattccatgatagtttgtgtgtttggtaaccgcaatgactgcaacgataatcaaagcctcgtgcaattctatctcccacgattttgtgcaataaaatcaaactttcttttgctttgccgttttcagcagcatcaatttggtattgaataaaacgatgtaaaataaatgtacttgggttttgttccagttgttggtgtaatttagtttgtgccgcaacaatgccgtctttttctgcgataagatccgataaagctaaatcaaccgcactattattgccggtttggcttgcccgaataagaaaaagttcaaagttgtctaaccgatttaattcttggtagcaatattttaatgccggtaaaatttcgctcatgtaatccgcattttgtgttagcacattttctaaatgttgcaccgcacgttgatattctaaattcacaatataacgttcagcaatgaggatagaggctctaacactcgtttttgaaacattcaacgcttgttgcaaaatatggattgcttgagcttgttgttgctcatcacttcctaaagtcagggaatattcgcagtagtaatgtgctaatgcaatgttatcttccgtaggcgaaattttggcaagtttctcggcaacattgatcgcttttttccattcttttgttttttgataaatgacggctagttgttgtaaagcattttcagcgtagttcggttcgtcaatcaataaaatataaagattttcagctcgatcataaaagcctatcgtcaaaaaatcttttgctaattgttgtttagcaagaagtttttgttcgaaggtataatttgaactgctatccaatgcttgatgaatacgcaaagctctatcaacttcacctcgagaacgatataaatttcctaaggtcaattcagcctcaaattgtgaacctgtttcaatgttattttcttgttcctgcttttgtagaatatcaaggaagagatctgccgctttttcgtgttgattagataataataaattaatacctgttacataatcacgagaaaatttattgctaatcgtatcttgatcttttcttgcactacgatgccccatataccagccgtaagctgctgcaatcggtaaaagcaggaaaagtaattcgagcattatacaaccttactctcgatttttgtttaattcatcaattaacgctaattgatgctttacttggcgagataaaaaaagattttttatttttaatttgatatagaagaaagcggtaattaaccaacctaaaagcagacctagcccaaacaagatagccactaaagttgataaacgtatttcattttgtgcaactacataattaaaggtaataatttgatcattgttagcaccaatagttacagcaactaaaacaaccgcaatcaataaaacaagacctataatatatttgatcatctctatctcctataactttctatttatggttaaactgattggaatcgctaaaagctcggtcattatgccaaaaaaataaaaaaaacgacactttacgcgtcgtttttttatattttatattacgagtaaatattaacacgctctttcagttctttaccggctttaaaatgaggtacatatttagcacttaaatctaccttttctccggtttttggattacgtcctattctagattgacgaaaatgcaatgaaaaactaccaaatcctcgaatttcaattctttcaccgttttctaatgcttgtgataattgttctagaatgtcttttactgcattttctatatctttcaaaggaacgttaagattggttgatgctaaattttcgataagttctgactttgtcataatatactcctagtgccggttggcataaatcctataattcatgccaaccaaaaagtgaatgaattattcaccttttgccgctttaaatgcttcagccattgcatttggaataacaatttcttctttattcacatttgcaactgccgccgcttcttctgcttggtcttttgctttaacagatagatgaacgatacgagatttacggtcaacaccggtatatttcgcttcaacaacatcaccaacaacaacttcattgctcaaatcagctgtacgaatatagccttcaacgccacttactaattcaactttagcaccttttgcgtcaacttcaaccactttagcactgaccacagcaccttttttgtttaccgcaatgaaattattaaacggatcttcttccagctgtttgatacctaaagaaatacgctcttttgcagaatcaacttgtaatacaactgcttctacttcgtcaccttttttatagttacgaacagcttcttcacccggaatattccaagaaatatcagataaatgtactaaaccatcaattccgccttcaagaccgatgaaaataccgaaatctgtaatagacttaatcttaccggaaactttatcacctttgttgtgagtttcagcaaactgtaaccatgggttaggtttgcattgttttaaacctaaggaaatacgacgacgttcttcatcgatttccaataccattacttcaacaacatcacctaaatgaacaactttagatgggtgaatatttttatttgtccaatccatttctgacacatgaaccaaaccttcaacaccttctaaaatttcaacaaagcaaccatagtcagttaagttagttactttacctgttaatttgctgttcaccggatgattttctgcgatggctacccaaggatcttgacccaattgttttaagcctaaagatacacgtgttttatctttgtcaaatttgaggactttaactgtaatttcatcgccgacacttacaatttcacccggatgtttaacacgtttccacgccatatcggtgatatgcaataaaccgtcaacaccacctaaatcaacaaatgcaccgtaatcggttaagtttttaacagtacctttaacttctgaaccttcagctaagttagctaaaatttcttcacgttcttgactattttccgattcgatgactgcacgacgagataccacaacattgttgcgtttttgatctaatttaatgactttaaattcttgttctttacctaataggtgatccgcttcacgagttgggcgagtatctaccaatgaaccaggtaagaacgcacgaacaccgtttaactcaactgtgaaaccgcctttcactttaccgttgattaaaccgataacagttgcttgttcttcgtatgctttttctaaatcaatccaagattcttgacgtaccgctttttcacgtgaaagtttagtttcaccgaaaccgtcttcaacagcgtccaaagcaacgtttacaacgtcacccactttaacgtccaattcaccttgagcattttggaattcttccgccggaatacgagcttctgatttcaaacctgcatctacgtacacgaagcctttttcgatagcaacaacagtagcgttaacgattgaacctacacgagtttcaaggtcttttaatgattcttcaaatagttgagcaaaagattctgacataattaatcttctaaatttaagttaataacgaccactttaatttccataaaaagtggggctgataataaatgtttattcaatccttgaataaacgagttcagattccaacggagagttcatcacacgactgatatgctctaatgcttgtttgatcacatcatcaattgttaattccgtgctatcaagtaataaagcatcttctgcgggcttcaagggagcgactggacgatttctatcacgaaaatcacgctcttttatctcggtcaaaatctgtgcaaagttaccattaattcctttattttgcaactgtttatgacgtctttttgctctttcttccgcactagcatctaaaaaaatttttacttgagcatgcggaaataccactgtccccatatcacgcccatctgcaataagcccttccccgtttgcaaaatctcgttgtaattgcaataacgctgttctaacttgtggaaacaccgcaatttgagacgcagcttcagccacttcttgtgtacgaatttttgtactaacattctcattttgcaaaatgatattcacttcgccatgttgtggaataaattgaatgtcgagactacgggctaattcagtcagtgccgtttcatcatcaagtgccacacttttttttaacgctgccaatgctgtcacacgataaattgctccgctgtctaataatcggaaccccagtttctcagctaaggcataacatagtgtacctttgcccgctccacttggtccgtcaacagtaataatcagatttttattcataaattgaaccttgatacaaaaatgcgtcatatattatgacgcactttattttttattcggctaatttcttctcaacagccttcaatcgcttgtttattttatcaatatctaaagttaatgcggcagttttacgccataccttatttggctgtaacggaattccggaagaatatattcccggttctgtgattggtcgcatcaccatacccattccagtaattgttactttatcacaaatttccatatgcccattaataacacttgctccgccaattaagcaatagcgaccaactttcaaactacccgccataataacaccgccggcaacagcagtacctgttccaatatgaacattatgtgcaatttggcaaagattatctatgattacattatcctcaatcacagtcgcatcaagtgcacctcggtcaatacaagtgcaggcaccgatttcaacatgattgcctataatgacagttcccgtttgtggaattttaatccagcgaccacgatcatttgcataaccaaatccatcactaccaattaccgcacctgattgaatgagacaatctgagccgattttaacgtcatgataaatattgacatttgcccaaagctgggtattttcaccaatctgcacatgcttaccgataaagcaacctgcaccaatcaccacattgtcaccaagtataactccgtcttcaatcaccgcattagccccaatggaaacatgttgacctaacgttgctgtgtcggaaacgaccgcactttggtgaatgccttgagccgctttaggtgtgctgtccatatattgtgccaaaatagcgtatgcaacataaggatcttttactacgagcaaattactttgtgcagaacagaattcgatatcactttcggttacaattaatgcaccggcttgtgattgaagcaaatgttctcgaaatttaggattggaaataaaggtcagttggttgttatccgctttatctaaaggtgctatgtccgttacaataacatcggcgttaccacgaatggtagcgccgatttgttgagccaattccagtaaagaatatccttgcattacttagcctttgcaggagctggagccggaatagcttttagaacttcctcggtaatatttttaccgtcagcaacataaattgccgttttttcatccaatacaattgtaaagtttttggctttagctacattcgttgtagctgtttgaacctcttttaataaacgttgagtaatttcggcatcacgtttttgtgcttcagcttgaaacgccgcaacatttttttggtgttccgctaccagcttgttaaactcgtcattacgttttgttaccaatttagcaatttcatcttgacgttttttgatatcagcttgacgtagtttcggtgcatctttttccaatgctttactttttgtttcaatttctttttcaaaattgtcacgtttttcaactaatgctttatctgctgcttccagtttttctgctggtgctttaaattcctcatttaatttttgaaactcaagcaagcgagcagggtgatttaaaaacaagtactctgtattaacaacagcgatattatcacttgccattgcaattgatgagcctaatgcgatagaaagagcggtcagttttactgcatttttcattgtttgaatatccttaataaattaattttaattgagttccgtacaatttaattatacgggtttcatatcagactattaattatagccgaaagttccctaaaaagaaccaccaatactaaattggaattgttcaatttggtcaccttgatattttttcagtggtttagcataagagaatactaaaggtccaatcggagaataccattggaacgcaatccctgctgaagctcttatacgagctgggttcccgtagtcaggtatatttttatctctagcaaatggtttaccatctgatttccatttagtattccatacagaaccggcatcggcaaagatagaggttctcactgatcgttggtttttctctgctacaaacggcgtcggaacaataagttcaatacttgccaatgtcatggcatttccgccaacaatatctttgctatggcatgtatattggttttggcttgtactttgcatacctccagccgcactgttttgcattgcactacaatttccattcccctgataaatcgcttttggtcctattgcaccatattcaaaaccacgtacagttcctatgcctccggcagaataagtttgataaaacggtaaacgtttaccgccaaaaccgtttgcatatgatcctgacaatctacctgtcagtacccaataatgatcacgatccaatggataaaacccctgcacttcagcactcactttatagtatctgttatctgaacctgggattgttactttaccgccaacattcgctcttactccggaggtaggcaaatagccacggtttaagctgttatagttccaaccgaatgaaaattcaaagtcgtgtgatttaaaattccatctattagaatcaggataccccattgatttgcgatataaatcacgattatattctttcgtcacattttttaattggctataaatatgccctaaacttaaataataggagttattttcattgaccggaaaacttaaatttccacttagaccgtaagttgtacgtccataggcggctgcagtatcactttttgagttatcgtgtttttcaaaaaatgcgtttccacctaaacttacaccatctttagtaaagtacggttcgttataacctaaattaagacttgtgccataattgttgcgtgaaccggctaaactaatcgaggaacccatgcccaagaaattatcctgtttaatacttgcctgataacttataccactttcagtaccataaccaataccgaagttaagactccctgtattgcgttctttgactcgataaatgacatcaacttggtcgttaatttgttgattggtttgagtttccgtttccactgactcaaaaaatccggtacgctctagacgaattttccctaactcaactaattgagatgataaccaagcaccctcttgttgacgcatttcttgacgtaatgtgctatcggcagtaatcgtattcccctcaaagcggatttgacgaacagaataacgatgtcccgcatcaacaacaaacgttaaatcaatcgttttgttctcttcattaaagactgaactaacatctacttttgccgttgcatagccttgctcgcttaattttgcttttatcaattgttcaacactgctaacttcactacgacggaaagtttctccgacataaatgtttttaagcaacggtgctaactcttctgacataccgcctacatcaccaacgattcggacactatttacagaatacttattaccttcgttaacttgaattctaactctaacctcagttttttcgtcatttagctgaacatcagtaccaacgatttgaaattttgcataaccatgttctaaataaaaatcacgaataagatccaaatcttggttaaattgattggtatcaaatttattcccaaataacttccaccaagcatccggctgtaattccatccgctcttgtaattggctactgctaaatgcttcattgccctcaaaacgcacttctttcagttttgccacatcactttcttttattttaagttttacttctgctcgatcatttgataatggattaacaattgcctctacagtcgtattataacgaccgacagactgataatgatcaactaaacttccacgaaacgcttccaatttttctcgatttaaaatatcaccgctagcaaatccgttcgctttcaagttttctcgtattgcttcactaggaatagattcatttccctccactttcacttccgcaatcactaagcgtggtactacagaaatgactaaggtatttccttcacgaacagcttgcacattatcatagccacgcaaaaataatagtcttacgacatttgaaatatcactctccgttgctttttgtccaattcgaaccggcaatccagataacaccgcactttccttacctgcttgaataccgtttatacgaatatcttgcacgacaaacggtgcggcaaccagaccagtcgagccaaataataggcttgcaattaacagttttttcattgttagttctatcctctaataaagaaatatctaagagtctgtttatcgattaaacaaaatcctgacgattataaacgtaaaaaatcattaaacaatacaaatattgttaatatcaataataatcccgcaccaattttatacgcaatattttgcatttgctcagataagggcttacctttgagtgcttctatggctaaaaaaagtaaatgccctccatccaataccggcaatgggaataagttcataatacctaaattcacactaatcaacgccataaagctgagatagtacacaaaacctatttccgaagatgccccagcacctttagcaatggaaatcggaccacttaaatttttagctgaaaactctcctgtaaacagcttaccgataatttgaatagttaatttgctcaattgataagttttctcaataccttttataaacgcctcaaaaaaaccatattttaattctgtgcgatattcatcacttataggataaatagtcggtgcgacaccaacgaaccatttccctttttcatttaagtgcggtgtaatcaccttatccagccattctccatgacgtaatacttgaacattgaaactatcccctttatcaacaaaactgataaaatcacgccatttcattggttcattttgataatagatttgatcaccaattaataaccctgcccgttgtgctggagaattttcaacgaccttagacagtgtcatctcaattttagttcttaccggaacaatccctaatgcaccaaaggccgtttctttttcaggatcaaagttccattcagataaatccaatacttttctttgctcgatatttgttgttgaggacttcaaaagtgttagcgtaacgctttcctcccccatttttgtagcaagaaccatattgatactttcccaatccggtgtcgatgtcccgtcaattgccataatttgtgagtaaggttcaagccctgccttctctgccaaagattgaggaaccacattttcaataacaggtttaatactggggataccgatagaataaaccgtcaaataggctaaaatcgcaaacagaaaatttgctataggacctgccgcaataacaaaagcacgttgcaaaatggatttattgttaaaggcttgtgattttaagttgtcaggaacttgttcattacgttcatccaacatttttacatatccgcctaaagggattgcggacacggcaaattccgtgccttgtttatccactttagaccacaagactttaccaaagccaatagaaaaacgatgaactttaataccgcactttcgtgctgcccaaaaatggccatattcatgtactgaaaccaatacaccgataacaatgataaaagaacctaaagaccaaagaaatgacataataatctctacaagaaataaaaatagaaataagcaaaaaacggaactgccgccgttaaactgtcgatacgatccaatattccaccatgtcccggaataagttgactgctgtctttaataccgcactcacgtttgaacatactttccgtcaaatctcccactatggaaatcgctactgtagcaacagataaggaaataaaagacagacgttctaacacaaaaagatctgccggcacaagattaatgaaaagtgcggcgaaaatacccgcagtaatcaagcctccaaatgccccctgccacgttttccccggtgaaactttcggtgctaatttatgtttacccaatgctcgacctgcaaaatatgcacctgaatcggctgcccaaactaaaataaatacataaagcaatagcattaaaccatcgtaaggattagaaacgtaattgtccaaacgtaaacgtaatacagcgatgaaaaaagggatcaaagtgcagaaagcaaaaataaattgtaagaaagaggatttagcccaaatttttgccgaagcaggataacgaataacaaaaaataaggcgatgaaccaccaaattaccgccatcaataatacaggttcagcatagttttcaaacactctgccaactgttaaaaaatgtgcctcaccaaaaatccacaaaaaaataaaagccccaaacagccctgtaatcattaaacgccaaaaaaattgtttaacaccaccaaactgtgtccactcccaaatacctaaagcaacaacgacaccaagagataaagcaaaatagaaaggggaaaaccataataacgcaattaaaacaaccacaattaatacgatagctgataatattcgttctttaagcactactcttctccatcattccgaactgccaaaacgacgttcacgttgttgataagctaatatcgcttgattaaattcctgttcattaaaatcaggccacaatgtatcggtaaaatacagttccgcataagcaatttgccataataaaaaattactaattcgttgctcaccacttgttctaattaataaatctactggaggttgtgaacctgttgttagatgatgttgaaaaatttgttcatcaatctcatcaatatgcaatttattttcttttaccaattgtaccaattgacacgtcgcctgaacaatatcccaacaaccaccataattcgcagcaatatttaaagtaagtgcggtattattttccgttaatttttctgctcttttgattttttcttgcaaacgctcattaaattgagaaacatcaccaataatttgtaatttaatgttatttttatgtaattttttaacttcaatatccagtgtttgcataaataaggacatcaaagcacttacttcactttcaggacggctccaattttcactgctaaaggcatacaacgttaaaactttaattccgatttttctagcataagaaaccgactctcggacagccttaatcccatttttatgcccccaaatacgcatttttccctgttgtttcgcccagcgtccattgccatccatgataatcgcaacatgctgaggaatattgtttaaatttaatgctgttttcgtcattatttaatcgatttttatcgaagtgaaattcggttgcgactataccataagttgatacggcttgctatgaaaaggcaaataaacagaaaaaaaatcctcttttaatcggtaaaaaacataagtttagtcgtttagttttcaggcttaacaaataaaatctcaatgttttcatcattaatgcgttaaagctgatattttcttttatcgccaatatcaaaatgtaaaggcattctccatttttgaagagaaactataagaaaaagtaccgcacttacgaccgataaaatatacaccatataagtcaaattaaattgtaggcttaaccaaagtgtggcaacaaaaaatggttgtaaatttaatgcaaacacacggaaacaaaaatattctttgaatgctaatccccctaaagtcaacaatgctccgcccagtgcaaactctggtaaattaaatagttggcaaattaatgcagcccaagttgccatttgtaataacaagcggatattttttaaataaatatgcaaagaagatgcacataacgttgctgcaataagtataccgtaatgtgcaatttccggcttataaggtaaaagtgcggtcatgattgcggctaaagtgaaaccgcaacgatataaaataactgttagataatcccaatgatccataggggatttaatttgaggatctgccatattatgttcctgatgtacgtaaaacaaagctattagccaattctcttgcctgcttatctaccagcaatacatcttctatactggtaattacttggctttcaattttttctaataccgctgtgttaatttttgctatatccgtaaattttattctcttatttaaaaatgcctcaacagccatttcatttgccgcattcaaagctgttgttgcatattgtcctgctgagaaagcctctatagctaattttaaacaaggataacgttggtaatccggttttaagaaagtcaacccacttaattgataaaaatccaatggttcaacccccgcaaaagtgcggtgaggatatgccatagtttctgcaatcggtgtacgcatatcagggttacccatttgtgcgataaccgaaccgtcaatataacgcaccatagaatgaataatagattgcggatgaataattacttccatttcatcagcactggcattaaataaccagcgtgcctcaatatattccaaccctttattcatcatcgttgcactgtctactgaaatttttttgcccatagaccaatttggatgtgccactgcttgctcgggcgtaatatgttcaaacgctttcaaatctgtataacggaaaggcccccctgatcctgtcagtacaattttgctaattcccaattgcgttaatggacaaaaaccaatttgttgctgagcttgtggaggtaacgattggaagatggcgttatgctcgctatctaccggcaaaagttgagccttattctttcgtacttcatcaataaaaatcttaccacaggttaccaatgtttctttatttgccaataggatacgtttacctgcttgtacagcggataacgtcggcaataaccccgctgcaccgacaatagccgccatgacttgatctgcctcaggatgagcagcaagttcgcaaatcgctttttgtccgctcaacacttcagttttactctccaagaatgccaacttttctcgcaattttttcgctgcactttcatcattcattgccacaaagtgcggttggaattttataatttgctgtagcataagttcgacatttttaccgccaactaatgcaagaacttgatattgctccggattctttgcaataacggaaagcgtactggtaccgattgagccggtagaaccgagaatgacaagtttttgtttattattcatactattacaaatttatcaaatatataacaaaaaacgcagtaaaaactgcgttttcgctaaattaatcatattagaaatcaagcaattctttttctttgtcagccaaaatttcatctacttttttcacgaaagtatctgtgatcttctggatttcatcttgtgctttacgctcttcatcttcactgatttccttatcttttagtaaggctttaatttgatcatttgcatcacgacgcacattacggatcgcaattttaccttgctcaccttcgcctttcacgattttaattaaatcacgacgacgctcctccgttaatggcggaagaggaactcggatagttgttccagcagaagacggggttaaacctaaatcagatgttaaaatcgctttttctaccgcactaatcaaagaacggtcaaatactgttactgccaaagtacgtgcatcttcagccactacgtttgcaagctgacgtaaaggtgtcggtgaaccgtaatattccacttgaataccatctaacaaactaggctgtgcacgacctgtacgaattttagcaatatgtgctcttaatgtttcaaggcttttttccatacgctgttgcgtatcttttttaatttcgttaatcacaataattcctttaaaaataataagataagtttaaaatctgtgttaatttactactaatcgcaaattaacgtcccttctgttttacctaaaatgacattgtgtaatgcacccgttttgctcatgttgaatacacgaattggcatattatggtcacgagcaagtgtaaatgcggctaaatccataacttgtaattctttttctatcacttcagcataagataatttgtggtaaagcactgcgttgggatttttcacgggatcgcaatcataaacaccgtcaactttggtcgctttcaacacaacatcagcctcaatttcaattcctcgcaaacaagctgctgaatctgtagtaaaaaatggactgccggttccggcagagaaaatgactacccgtttttcacataacatttttatggcttccgaccagttgtatgtatcacaaatcccattcagttggaaagctgacattaatttggcatttacattagcacggtgcaacgcatcacgcattgccaaaccgttcatcactgttgcaagcattcccatgtgatcaccaacaacccgattcatacctgctttggctaacttggcaccacgaaataagttgcctccgccaagaacaactccaacctcgacacccaaacccaataaccctttgatttccagtgccattctatccaagatagacggatcaataccaaaaccctcgtcgccttgcaacgcttctccacttagtttaagtagaatgcgtttataaattggttggctcatttccttacccctttcaataacccagagacaaaatctcgcttattatagttcaacctgactggcgtgcaagtattcattgaaaaatacccttaattattttaaaccagttttaagtcaggattaatcttgaacgctaatttatttacacttggatactgacgttggatcaattgcaataaaggcgattgctgaaagaggaaagcttgtcgtacagttgcattaacgacttcaatccacatagtgtcagattcaaaattgataacacgataaaaccccttgaactcaataggaaataaatgttgtatttgttcatttaattcttctaaaagcgacgctttttgaatgatttgcatcaaaggggagttttccaataactcattgaaatttttcggcttactgtatctcatcttgattttccaagtttcgtcctaatattttatacagagttatgacattgtaacgaatttccgttacaatacgcagaaaattttgtggtaatgtaaaacaatgattttaattaaagggaaacagtatttttggtcgcaactgctattaagtgtcatagcgttctttactttacccgttgcacaggatatagctccacaaaagattactaatgattacccaaaaacacaaaatgtaatacagcaactttactataccgcatcaaatattcaacaagtgcaacagcaacaattacgacaaattcgttatgttgttactgaatcatcaattccttttcaatttgtaccgctctttttagttggacaattcagtcatctcccccctattcgtgccggtccgtaaagaaattaaatttaaatttatttcagtgccaaatattattaggcgaatttgtttattcaattataaaagaaaaatactatgttaagaactattgttacaaaaatctttggcagtcgtaatgaccgcattttacgtcgtttagctaaacaagttaaaattatcaataaattagagcctgaatttgagcgcttaaccgatgaagaattaaaatccaaaaccactgaatttcgtgcaagattgaaaaatggagaaaaactggaaaatttaattccagaggcatttgcaaccgtgcgtgaagctagtaaacgtattttaggcatgcgtcctttcgatgtgcaattaattggcggtatggtgttaaacaatcgatgtattgcagaaatgcgtacaggtgaaggaaaaaccttaactgcaaccttaccttgttacttaaatgccttaacgggaaaaggtgttcatgttgttaccgtaaatgattacttggctcgccgtgatgcggaaaccaatcgccccttattcgaatttttaggtatgactgtaggcattaatgttccgggtttatcaccggaggaaaaacgtgccgcctatgcagcagatattacttacgcaacaaatagtgaattaggctttgattatttgcgggataatcttgcacattcagctcaagatcgctttcaaaaacacttacattatgctttagtagatgaagtggattctattttaattgatgaagcccgtacgccgttaattatttccggtccggctgaagacagttccgagttgtatatggcaatggataaactgattccaatccttatccaacaagataaagaagatactgaagaatatcaaggtgatggggactttacactggatctgaaaaataaacaggctcatttaaccgaacgtggacaagaaaaaattgagcaatggttaatggaaaaaggttttattaatgaaaatgaaagcctctactcccctgctcgtatttctttattgcatcatatttacgctgccctacgagcacacaaactatttgagcgtgacgtagattacattgtaaaaaacggtgaaattgttattgttgatgaacacaccggtcgtacaatggctggtcgtcgctggtctgatggcttacatcaggcaattgaagcaaaagaaggcgttcaaattcaaggagaaaaccaaaccgttgcttccatcacttatcaaaactatttccgtctgtatgaaaaattggcaggtatgacagggacagcggatactgaagcatttgaatttcaacaaatttatggtttggaaaccatcgttatcccaaccaataaaccaatgattagagatgatcgcactgatattatgtttgaaaacgaaaaatataaatttgatgcgatcatcgaggacattaaagactgtgttgcacgcaatcagccggtattagtaggtacgatctctatcgaaaaatcagagttactttccaatgcactaagcaaagcaggtatcaaacataatgtcctgaatgccaaattccatgctcaagaagctgaaattatcgccaatgcgggatatccaagtgcggtcactattgctaccaatatggcagggcgaggaactgatattgtactgggcggtaactggaaagctgaagttgctaaattggataatccgacggaggagcaaattgaggcaattaaagcggcatggcaaattcgtcatgaaacggtaaaacaagccggtggattacatattatcggaacagaacgccatgaatcccgccgcatcgacaatcagttgcgtggtcgttcaggtcgtcaaggtgatcccggttcttctcgtttttacttatccttagatgatgctttaatgcgtatttatttaacagaaggtaaattaaacttcatgcgtaaaatgttcacagaaaaaggtgaaggcatggagtcaaaaatgctggcgaaagtgattgctcaagcacaagcaaaagttgaagcacataactttgacggacgtaaaaatctgcttgaatttgatgatgttgcaaatgatcaacgccatgcaatttacgaacaacgtaatgctttactggataatgaagatattgccgacactattcaggtcattcgccaagatgtcttcaatcatgtcattgatgaatatgtcccgccgcactctttggaagaacagtgggatattcctgcattagaaacccgtttgaagcaagactttgctcttgatttgccgttaagtaaatggctggaggaagacaatactttcaatgaagatgtattacgtgaacgtgttttagcagttgctatttctgaatataaacgcaaagaagaattggtaggtcacgaaactatgcgtaattttgagaaaggcgttatgttacaaactcttgatgaactatggaaagagcatttatcggctatggatcatctacgtcgaggtattcatttacgtggttatgcacaaaaagatccgaaacaagagtacaaaaaagaatctttccaaatgtttactgacatgttagatacattaaaactaagcgtcattactacattaagccgagtacaaattcgtactcaagatgaagtagaaaaagcggaacaggctcgtcaaaaaatagctgagcgtgaaaatgccgcaatgcaataccaaaataatgaaggaacatcatcacttcacgaaaaatcagaacataagataggacgcaacgaatcttgcccttgtggttccggaaaaaaatataagcattgccatggtagcaaagcaaaatattaattaatatggcggtggaaatttccaccgcactttttaggataaaaccatgataaaaccaacaatccaagttgccgctggcattattcgtaacgagtttggacaaatttatctaactcaacgactagagggacaggattttgctcaatcattagagttccccggtggaaaagtggatcaacatgaaacacctgaacaagcactggctcgtgaattagaagaagaaatcggtattcatgttctaagtgcggtgctttttgaacgtttttcttttgaatatccaactaagattattcaatttcatttttatcttgtcgaacaatggattggagaaccgtttggacgagaaggccaagaaggtatgtgggttgatcaaaatgagcttgatgacagccaatttcctcctgccaattttaaacttattcaacgattactagcagaaaaatagcgataacaattatcttctcgttatatcagctttataatcgtatacaaacaagagggcatttacaaatttagcattttacgtccgcaataacattcaaaattcttttatctgatataggatatttagtgcctagttgttgagcaaataaactgactcttaattcctcgatcatataaggaatttctttaacttcactcgagtgcggtttagatttcggcagttttgctaaaagttgttggtacgcatgactaacctgttctactctgagcattgcagcacgatcacgattaatatcttgtgctaatttatcaatacgcttatcaattgcctgtaaataacgctgaatatcagacaaacgcccataacctgttttcgttacaaattccggataaataagtccattcatttgtttttttatatcagcaaaagcaaatgccattgtaaaatccatttttcctttcaggcgttgattgatttcaaaagtcaaggtcaggattttttcaacttgctttgcaatttccactgtaacctcattcagattttctcgaataaaatcacgcaatctctcaaaatcagtttcattccaaaccaaaccaccaaaatcagcaataagtttatccactgcacaagcaatgcaatcatcaattaaatctaaaactcgtccgaaaggcgtaaaatacaaacctaacttcgatttgttcggcaatttttcatgtaaatatttaatcggcgaaggcacatttaatagcaacaaacgacgtaatccttgctgcatagtaacttgctgttcaagctctgtttcaaatagcttaatgccgactgaatctttttcatcaacaatagcaggataagccttaatgctaaaaccttgttttttctgttcataaaattgcggtagtcgagcgaaattccaaacatgaataccgctttgttcaataccactatctgcaacgcaggaaatacttttttgcactttatcttttaggctaaatttcaattgatctaaatcaaggctttcggcaattttgcctcccttttcatcaatgaccctaaaggtcattcttaagtgcggtggaatctgtgctaaattccattcttcaacttcaatctgaactccgctcatacgacgcaattcatgactaagcgtttctagcaaaggtttgtcggtttgcgttattcgacctaagaaagcactggcatagttaggtgcgggtacaaaattacggcgtaaagatttaggtaaagatttaattaaggcaataactaattcttggcgtaatcccggaatttgccaatcaaatcctttcatttcaacctgatttaatagtggcaatggaatatgcaccgtcacaccatctgcctctatacccggttcaaattgataagttaattttaattttaaattgtcttgataccaaaaattggggaaatctaatttgttgatattggcattgtcttcgttcatcagaaaagacttttcaaaattcaacaattcaggttcttgttgtgcttttttcttccaccaactatcaaaatgtttttgtgaaacaacatcggtaccaatccgttgatcatagaaatcaaataaagcacgctcatcaactaaaatatcccgacgacgtgttttatgttccaattcttcaatttccttaattaatttttgattggcaaaaaagaatttgtgtcgggtattccaatttccctctactaaagcggattgaataaaaatttctcggctggtaacagcatcaatagcaccataattagcaagcctattagttacaatggggataccataaagactgactttttcatttgcaatcacttgtcctcgagactttgaccagcgaggttctgaataactggatttaatcaaatgtttcgctaacggttcaatccattccggctcaatatctgccattattcttccccaaagtttagaggtttccactaattcggctgctacaacccatttaggttgttttttaaataaaacggaattggggaaaatagagaaatgtgcatttcttgcccctaaatattgctgtttttcattttctttcaatccaatatgggatagcaatccacttaaaagtgcggtgtgaatttgtgcatattcagcctcatgagaatttatgggcaaccccatttcacgcacggttaaacgaatttgatgataaatatcctgccattcacgaatacgtaaataatttaaatactcttttcgacacaagcgacgaaattgatttttgcttaaaattttctgttgctcttgaatgtaattccacaaatttaaataagctaaaaaatctgattttttatcagcaaaacgacgatgtttatcatccgcagattgttgtttttcttgcggtctttctcgaggatcttgaatagataaggcagcaacaataatcatgagttcatgtaaacaagaaaattgtaccgcacttaataacattttagccaaacgaggatcaacgggtaattgtgctaactgcttaccaatagcggtaagctggcgtttctctccttgcttgttttttttccattcaaatgcctgcaactcctccaagagcttcataccatcttggatatgacgtttatccggggcatcaacaaaaggaaaagcttctatatcatctaaacctaaagcggtcatttgcaaaataaccgatgccaaattggtacgaagaatttcaggatcggtaaatgccggacgattattaaaatcatcttccgaatacaaacgaatacaaatcccttcagacacacgcccgcaacgacctttacgctgattagcggaagcttgtgaaattggctcaatcggcaaacgttgtactttagtgcggtagctgtaacgtgagattctcgccgtgccgggatcaataacatattttatacccggtacagttaatgaagtttccgctacattagttgccaacacgatacgctttaaattactcgggtgaaaaattttattttgttcttgtgctgaaagacgagcaaagagcggtaagatttctgtatgttttaaatctaatttttgtaatgcttctgccgtatctctgatttcccgctctccatttaagaaaattaaaatatcaccgactttctctgcctgtagctcttctaccgcatttaaaataccttgtaactgatcttgatcttcttcctccacaattggacgataacgtacctctacagggtaagttctaccggaaacttctataatcggggcatgattaaaatgttgagagaagcgttctacatcaatcgtcgctgaagtaataattacttttaaatcaggacgctgaggcaacagctgttttagatatcctaaaataaagtcattgtttaagctacgttcatgtgcttcatcaataataagtgtatcatattgatttaaaaaacgatcagattgaatttctgccaataaaattccgtctgtcattaatttaatttgtgtttcatcgctgacctgatcatgaaaacgaactttataacccacgactccaccgagttccatatttaattcttccgcaattcttgcagctacggaacgtgcagcaatgcgacgaggttgagtatgtcctatcaatcccttctgcccaaaacccaattctaaacacatctttggtaattgagtggtttttcctgaaccggtttctccagcaataacgactacctggtgttcccgaataagtttctggatttcagcttttttttgattgaccggcaaattttgtggaaattcaattttttgtaccgcactttgtcgttgtaaaaaacgaaagtgtgcctgctgaatttgctgttcaatttccactatcaccttgttgatattcgtaggatttttaagttgattcatgcctttgatacgagcaagcaaacgacgccggtcaatcgacatcatgtcgttaagctgtgccaataatgtctgctgttgtgtgctaaaaacattttttttattattcttcattattcttatattcaaatttagtcaatcatgtaacgctaaaaattatttatcctgtttttccaataaacaaagacaaaatccctgcggcaattaacggtccaacaggaacaccccctaaaaatgcgacacccaaaatagtacctactaataaacctgtgagtagcgaaggttgcgtccccattaaattcacaccacgtcctccaaaccatgcaacaagcacacctaccgccatggctaaaaacattttccaatgaataagtgcggtccaattcggcaactgaaccttgcctgaaacgatgggactaagtacgccaatggtaagaataataataccaatattaactccatacttttccgtaaaaggaatatatttggctaaaaatgtttgttgcattaaaagtaaaatagttgcggaaatggttatggagctattattgcctagtacaccaagcaaaataaggctgactaataataaagcaattgagttaaactgtaacgacattgaaatattcctaacggataattaattctcataaaacggtgctaattatagcaattttctacatgcttgcgactttttcgttatcaataaaaaagacattacagcaattatttaacaatattttaataattaaaaaacatctaatttacttaaataaaatttaaaaaataaacaatatattaaatataatttcaatttttagggtaaattttatttttttatattttaaaataattctatttgacctttcaattatttttgggtatatctaccccatcaaataaatttgtcatctttttaagtgaggatcttatgccccaaaaatactcaacgctaaaaaataacataaatatgttaggccactttttaggcgaaacaatcagcgatgcacagggtagtgatattcttgatttgattgaaaatattcgtgtattatctcgcgactctcgttccggtgatgaaaaagcacgggaaaaattattagatacgctttcgactatttccaatgaaaatattattccagtagctcgtgcttttagtcaatttttgaatttaaccaatatagcggaacaataccaaacaatctcacgaaaacacatagaccaagttgcctccgatcgttctttagaggcactctttgaacgcttaaaagcacaaaatataccggcagaaaaagtcatctcaacagtagaaaaattattaattgaattagttttaaccgcccatccgacagaagttacccgccgttctcttttacataaatatgtagaaattaaccgctgtttaagccgtttggaacacgatgatcttactcaatcagaaagcacaaaattaaaacgccgtttaatgcaattaattgcacttgcttggcatacaaatgaaatccgtacgcaacgccctactcctgttgatgaagcaaaatgggggatagcggtaattgaaaacagcttatggaaagccgtgcctgatttttgtcgtcaattgaatctccatttagagaaaaattttggtgtacaacattcagtaaacttagcacctgtcaaattttcttcttggatagggggagatcgtgatggtaatccatttgttaccgcagagacaactcgccaagttttaatcatgaaccgctggaaagcggcagaattgtttttagcggatattcaagttttatcagaggaactttctgtagttcattgcactgaggaattccgtgccaaatacggtgatcatttagaaccctatcgtgtagtcgttaaaaatttgcgagcaaaactggtaaaaactgtcgcttattacggtgaaattttagaaaataaaccttcaaccatcaatacaaatgacattttgaccgatgatcaacaactttgggagccactttacgattgttatcaatctttacatcaatgcggtatgcgaattattgctaacggtatattgctggattgcttacgtcgtattcgttgctttggtctctctttgtctcatttggatattcgtcaagaaagccttcgtcatactaaggctctctctgaaattactcgttatattggtttaggcgactattcacaatggatggaagatgataaacaagcttttttaatccgtgaattaagctctcgtcgtcctttgctacctcgcaactgggcgccttctccggaaacgcaagaaattttagagacttgtcgagttattgcacaacaacctgaaggcgttatatcttgctatattatttctatggctcgcactgcctcagatgtgcttgcagttcacttattattaaaagaagctggcgtaacctattatttacccgtagttcctctttttgaaaccctagatgacctcaatgcttctaaagaagttatgactcaattatttaatgtaggctggtatcgtggtgtgatcaacaataaacaaatggtcatgattggttattccgatagtgcgaaagatgcaggtatgatggctgcttcttgggcacagtatcgagcacaagaacaactggtaaatctttgcgaaaaaatgggagtagaattaaccttgttccatggtcgtggtggtactattggacgtggaggtgcacctgctcatgccgcacttctatctcagccaccccgctcattgaaaaatggcctacgtgtaacagaacagggagaaatgatccgttttaaactgggtctacctgcagttgcagtaaatagctttgatctttatgccagtgcaattttagaagccaacctgcttccacctccggagcctaaagaaagctggcgtgcaattatgaatgaattatccgattcatcatgtaatatatatcgtagcgttgtacgtggagataaagattttgtaccttatttccgttccgccacacctgaacaagaattatctaagttacctctaggctctcgcccatccaaacgtaatccgaacggtggggtagaaagtttacgtgcaattccttggatcttcgcttggatgcaaaatcgcttaatgttaccggcttggttaggtgcaagtgcgtctattcgtcaatcaattgaaaaaggcaataaagaaaccattgaagaaatgtgtaaaaattggccgtttttctctacccgtatcggtatgttggaaatggtgttcagcaaaactgatacgtggttatctgagcattatgatctgaacttggttaaaaaagaattatggtatttaggtcaatctttgcgtgaacaactgcaagccgatattaaaactattctttctttatctcatgaagatgaattaatgtctgatttaccttggattgcagaatccattgccttacgtaatatctataccgatccgctcaacttactacaagtagaactgttgcgacgtttacgtgaaaaccctgaaaatccaaatcctgatgtggaacaagcattaatgattacgattacaggtatcgctgcaggtatgcgtaatactggttagtgatgaactcatcatacaaaagtgcggttaaaatcaccgcacttttttctattcctaacttttatgctatgatgccttcgcctttacttataggaagatatgatgacagaaaaatttaaaaaattagctcctgatacagcaattgatattgcttatgatatttttctcgaaatggcgggagaaaatcttgatcctgccgatattcttttatttaacttacaatttgaagatcatggcggagttgaatttgttgaaactgccgatgactgggaacaagagattggcgttctcatcgatcctgatgaatacgctgaagtttgggttggcttggtcaatgaacaagacgaaatggatgatatttttgctaagtttttaatttcccacaaagaggaagaccgagaatatcacgttgtatggaaaaaataatctaagctcaaaattgaggaaaatttgcggttcaatagcctcttcgtataattgctgaacttccgattttgctatttaatataaatcctagaatattactattccaaataagaagagcggagaattccgctcttttagccttcaaatgcgttgtgattagttgaacatggcagaaatagattcttcattactaatacggcgaattgactctgccagcatacctgataatgttaatactcggactttgcccaatgccttaatttccggtgtaaatggaatagtatcagttacaacaatttcatctaatgcttcattcgctagattttttgccgctgctccggagaatacggcatgagttgcataagcaaatacacgttttgctccccgctcttttaatgcttccgccgctttgcataatgttccgcccgtatcaatcatatcatcaactaaaatacaatcacgtccagcgacatctccaataatgtgcatgacttgggccacattggcttttggacgacgtttgtcaataatcgccatatctgtatcattcagtaattttgcgatagcacgggcacgaacgacaccgccaatatccggagaaacaacgatcggattttccaaatctgttttctttaacatatcatgaataagcaccggtgaaccgaatacattatctaccggtacatcaaaaaatccttggatttgttcagcgtgcaaatcacaagttaacacacgatctactcctacgctcgataggaaatctgccaccacttttgcagtaattggtacacgggctgagcgtacacgacgatcttgacgagcatatccaaaataaggaataactgcggtaatacgacccgccgatgcacgtcttagtgcgtcaaccataacgactaattccatgagattatcatttgtaggtgcacaggtagattgaataataaatacatcacaaccacgtacattttcattaatttgaacttgaatttctccgtcactgaaacgaccaacagtcgcatcacctaaggaaatatataggcgttcggaaatttgttttgccagttcaggtgttgcattaccggcgaaaagtttaatgtcaggcatcgtaaatttaacctctggaatttgtattattaggaagacaaagtgtttgtttttgttgcgataaatattcaatcatttgatgtaatggtgaaatatttgttccctgagcaacaaaaccaacgtatttttcaggtttatcaagaaatgcagattgtgccgcctgttcgttagcaaattcagcgaaaacacaagctccagttcctgttaatcttgccggtgcatattgtaacaaccagccaagggcttcttcaacctctgaataatgatttaaaacaactttttcgcaatcgttttcatattttgttgttaataattccgctaaaggtcgttttggggtattgcgaggtaagttagaatctttaaatataatagctgtagaaatagatgtttcgggttttaatactaaaaaccatttttgtggcggttgacaaaaagtaagtttttcaccaacaccttcggcaaaagcggcttttccatatacaaaaacaggcacatcagcaccgagctgtaatcctatttcagcaagtgttgagagtgaaagttgtgtattccataaatagttgagtgcaacgagtgctgtggctgcatttgaggatcctccgccaacccctccgcctattggcaaaattttatctaaatgtaaatttgcccctaatgtacaccctgttttttgttgtaataatttagcggctcgatagattaaattatcctcgttttttagatgaggtatttcgggtgttaagattatttttccgtcagtgcgtatctcaatacttaaccaatcgccaaaatttaaaaattgaaataaggtttgcagttcatggtaaccatcggggcgttgagaagttatatataaaaacaaatttatctttgcagggcaaggaaaacgtaatttttttccttgtatttgcgatgataaaagtgcggtcgaaaattgatagtttttcattaatatttccagttatctatcctaacttttaaggtctgctcactacttttcagaagaatatctttgggtaatggaatgctttgatctgttcgatagttgagatagtcagcactccaaacttcaccctcaactgaataagtaaagcttgctaataaatgatttatgccgacctgataatctgaattttcatctggttgaccttttagccagttccctatttgttgtaatggaatagagataccgatcatttcacggagcaagttgttgatatcttttgttgaacgctgatttcctttatggtctgaaacagtaataccaaaaggtgaaacttcaaatttaagtattgaactgctgaaagctgatgaaagtagtaaagaataggattgcggattgttatattgccaagtaaagcgagtggaaaaacgttgtttattgttaatataacccaattgtccttgagcttgatattgttttatttgcttaattttttgtaggtgttgttgccattttttatcatttttttctatatactgaataccttgcgggcgttcgctggcaatatctaaagtacaagcgctcagcaatatcgttaaaataagtataaaaaaaggtttttgagatgttttcatgtgtcggactcgtaaaaatatcggatattttaaggtcttacataagattagtaaagatacaaaaacttttgattttttgaccgcactttgatctgtttattaaaagatgccaatttaaatttatttgaagggtagcttacttcaatttttacaatgatctctttttaaggaaacacaatgaaaaaatcatttatctcaattgtggcgttagacttattgggagcggtttgggttggtacttcttggtataccggtaaagtagcggaacaggaatacaagacacacttagaacaggttaaatcgaaattacccgtaaatccgaacccgatagctcatctacatgctaagatcaatgatttacaatttaatggtcgttcttttactgatgaagatattaaacatgtaataatgaacagcggaattggggataaattaggtttacagtagattgtaggttggctgatttttatactctgccaattttttctcaacaaaggggattatggagaaattttaaccttgaaactcattgccccaagcaacttgtttggaaataactttatacataatggtgattatagttgctatttttttgaagacgaacaataatagtgtaccgataagcaagaacaaatgatttttgcgaggatattttttgataaactacgatatggttatttttccgtatcgtagttttgttttacttaaaaaggaagtgtacaacaatgaaacaaattccaatgactgtacgtggtgcggaacaattaagagaagaattagattttttgaaaaatgtgcgtcgtccggaaattatcaaggcaatttcagaagcacgtgaacatggcgatttaaaagaaaatgcggaatatcatgcggcacgtgaacagcaaggcttttgcgaagggcgtattcaagaaattgaaggtaaattagcaaattgccaaattattgatgtaacaaaattacctaataatggtaaagtgatttttggtgcaacggtcgttttgttaaatattgataccgacgaagaagtcacttaccgaatcgttggagatgatgaggcggatattaaatcgggtttaatttctgttaattcgcctattgctcgcggtttaatcggcaaggacgttgatgatactgttgtcatcacaacacctggcggtaaagttgaatttgaaatcgttgaagtagaatataaataacataacactttgataggaaaaaaatgggcttaatgcccattttatttgtttcagttattggcgaggtaactgaattttgggttcattacttggacgataaagtacaagaacatgccctatagtttgtaccgcactggcttgcgtttcacgtataattgcctcaataatcagctgttttgtttcacgttcagcaccagaaattttcactttgatcaattcgtggtgatttaatgcgttgtcaatttcagctaaaaccccttctgttaaaccatttgtgcccagcataaccaccggatttaaatgatgtgctaaaccttttaaaaattgtttttgttttgttgataatgtcattggttacccatcctacataattaaaagtgcggtcaatttgataacaatatttcaattgcctttatctcgaagattttaaccataaatccaaaaaataaaaagaaggaataattattttatagaatagttaaaacactttccggcggtcgtcctattttagctttatctccatttactacgattggacgttcgagcaatgcggaattttgcgagagtgcaatcaaaagttgttgttccgttagctcctgactattcaatcctaattgtaaataaagatcgtctttcgtacgcatcatctcccttacagacgtaattcccaatttttgagctaacgtttgcaactcttcaacgctgtaagtttgctgtagatataattcaacgtcaaaaagaatggattgttgttccaataaagccaatgtttcacgactttttgaacaacgtggattatgataaattttaaccgtcataaatgctcctttgctcagatacagttcaaatatgcaaaattttaccttataatcacccaaaatgctcattcgttaaggataaattatgattgaaatgttaaaaaattggtatcatcgtcgctttaccgatccgcaggcgatggcacttttcgctattttattctttggatttgtggcaatttattttttcaatagtttattggctcccctcctgattgcgattgttttagcttatttacttgaatatcccgttcgcttattacatgaaaaactgaaactgcccagaattttggcgacatctcttatactcggtggctttatagcaatcacatttgtcatgacctttattttgatcccggtactctgggcacaaaccatcaaactggtcagcgacttaccacacatgttcaatcaacttaacgaatggttgctttctttaccggagaattatcctgaattagtagattatcaaatgatagatgcgttttttatttcatttaaaaataaaatattaggcttaggtgaatctgcacttaaactgtccattgcctccttgttaaatcttgttaccttaggaatttacgcttttcttgtgccattaatggtatttttcctcctcaaagataaaacggaattaattaactatattacaaactttctgccaaagaaccgcactcttgcctcaaaagtttggcgagaaatgcaacaacaaattgccaattatattcgcggtaaattacttgagattttaattatagctttagtcagttatgccatctttctattttttggtttgaattattcattgttgctggcagttgccgtgggattatctgttttagtgccatacattggtgcagttctggtcactattcctgttgctttagttgccatgttccaattcggtgcaaccccaactttttggtatttaatggttgcttatgtgataagccaaatccttgacggaaatttactcgtgccatttttattttctgaagcagtgaatttacaccctctcactattattatcgccgttcttatttttgggggattatggggtttctggggaattttctttgcaattccattggcaacactagtcaaagccgttgtttcatcttggccgtcaacagaataaccgataaggaagaatttcattgaaagggctatttattaggattgttttagccatctgtttatcgctttgggcaatagatatggttttcccttggcaacaaatagtgagatcaaaacagaattaccatactacaattcaagagcgacaaaaattgattgtaggaacaatcaataatccggtgtcttattttatcggtacaaacggagaaacagggctagaatatgaattaagcaaggcttttgcaaattacttaaatgttgatttagaaatgtttcctctaaatagtgcggacgcattatttcaggctttagcacaaggtaaaatagacattgccgctgcaagtttattttatcaacaagatagaagtgaaaaattcaaactaggtccggcatatcacgctgcatcttggcaattgacttatcgcaaaggtgaacgtcgtcctatcacattagaaaatttatccggcaaattggttattccggctaattcggcactgaataatattctgctggcaaaaaaagaaaaatacccttctttaacatgggaaaccagtgaactaagccaagaggaactcttatttcaagttgctgaaggaaaaatagattacacaatcgctacctctactgaagtatcagttaatcagcaaattaaacctcaaattgcaattgcctttaatgtgactgatgagtttacagtacattggtacttatctgataagggggcttcagaattacaagccgcactattagacttcatgaactctgccattgaaaacggcttaattgctcgtattgaagaaaaatatttcaatcacctcaaccaatttgactatgttgatactcgctcctatttgaatgcaattgaaacagttttgcctaaatatgctcctttgtttgaaaaatataaaggtgatttagattggcgtttattggcagccatatcttatcaagaatcccattggaatccggaagcaacctcaccaaccggagtacgcggtatgatgatgttgacaaaagcaactgcagatagaatgaatattactaatcgtctcgatcctgaacaaagcattaaagccggttccgaatatttacatcttctgctcaaacaaatgccggatactattttaaaagaagatcgtatttggtttgcacttgccgcttataacatgggattgggacatttattagatgttagacgcttaaccaaacagctgggaggaaatccggataattggttagaggtgaaaaaaaatttacccttattagcacaaaaacgttattttacccatcttaaatatggctacgctcgaggctacgaagcgtttcaatatgtggaaaatattagaagatatatgaacagcataatgaattattatcggcttcaacaaaaccaacaagatcggtatgaaaatgaaaataatgatgtcatttcaatacaaacacaacaggaacaacgatgagaagaaaaacctttttaaaaaaaagtaaagtcacgctatatcgtaccgcacataaccgagcattaagaattaaacgcttaaaaaaacgtaaagcccaacaagcagcacgacatgcccagcaattcgtcatacaagaaatttgttgctgatttttcgtgctgtaaaatcatattctttagcatatggatataagaccaatcagataaaaaagcggaatttccaccgccctttttgctttacataacacaccctaccaaaaccggatcgttaaattctgttttacagcaacccttaattaacaaaacattcaaggcaagcgaaaagaaaaaagaaaaagaaaaagaaaaagaaaaagagaaaagcgaaataaaaaatgattgccttattaataaattttgtaataaaatctccgaaatttattactatccgcttgacaaacaaaaataacatgaatttacagcctacagcctacagcctaggctaacgccttgttgcaaatcttgcaaaataaattttaaaaagtttttaacctctaaaaatatcccagttttcccttttcaacctctcggcgaaaatatcattcgtctttttttgctttgccttaaaaagcaaagcannnnnnnnnnnnnnnnnnnnnnnnnnnnnnaaaaacaaaaagtttaatccattcacaaccataaaaaagtgaaaaaaaatcaacaaaataaattattaaataacccattttaaaagattaaagagagtaaaccatgaacaaaatcttcaaaaccaaatacgatgtaacaacaggtcaatgtaaagccgtgtccgagttggcgagcaatcgccaaatagcgagtagctcggagaaaaagccaaagtgcagtgctaatttgaaaagaacgagcttgtcagaaaacttactgttcaacatgctgatcagcggtttggtgttgtttgcgtatcccgcttgggcaacagcagctcaagctcaaactaacaaagaaggagaaatcaaaatagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggtcaacgggtagtgcttggtaataaagcctacgccataggcaatcaggcggtggggataggtggtgacgtattcgcccaaggctattcctctatcgccatcgggagcgatgatatcggcgaaacggctgaggagaacccaaaaaatggaagtggaaatgacaaatactccaaatacgccgtccccctacctaaagccatctggcagttgtttattgatgagggagataattttaattcaaaaacgaaaaataactatgctattttacaaaatggtaatagtgacggtagcaacggcaaagccaaaaatatttcagagtttaatagcaatgggaatggtaaaccaaaaatcgacagaaataaacaacctgatgaatgggaaaaagcatatgcagaatttaataaagacgcatatgaaaaatacgtagaaggcacccaaaacggcggtagcagtcaacccaaaaacgtctactcccacacatgggcaaaagggcgtggggcgattgctatcggagcaagatcaatcgcctacggcgaccattctaacgccataggaacgcttgccatcgcaaaaggaaactactcgtccgcctttggtacgggaaccatcgcttttgaagaaggaggtattgcagtcggaaacagtgcgtatgtttatcgagaaaattctatcggcgtgggaaataacgtccaagcaatacaaaaaggctcgatggtcttcggggtcaattcctatgctggcggtagcggttctttggcattaggggaatatacctttgcgaatgtcaccatgcatgatgagtttaatgggaaaacggaagctaagaaagtaacagaatttacaaaaataatggaggattataaaaataaatataatgcagagaatcctgacaaatcaccgttaacatttgctagttatacgcctgattcaccagaggaaaaaataaatatagaagacctttatactgtgccagcctatgatactaaaacgatacagcatgttggaaaacaattttacaaagccaaaacaactaaacaactaggtacaggcgaagaaaaagccgaacaatccaaagacagcaaaggcacttataaccaaggcggtatagccattgggtcgtattccgtcgcattgggggataacgcccttaccctcggtagacacgcctacgccaaagaagacagcacggttgccatcgggaacttcgcctttgcaaaagatgaaaacgccttcgccctcggcaaagccgcccgatctatgggtaaagattccttggcaatcggggtggaagcggaaatttggagtccagatgccgtggcaatcggcacaagatctaaagtggaacaaaacgccgmkggcggtgtcgccattggacaaagtgcgryrgtkgmarysrrygcyggygattctattgcgwtkggtaaarrttctaaggcgrragmgaagaaacaagcctttaaaacccaagaagttaatgtgggtacaaaaggcttgatgtttgactggggcagtgcaggcacctcagaaaatgatcaagaggacaagaaaaaagccgtggtcagcgtgggaaatattggtagcgagcggattatcaccaacgttgccgctggttctgttatgaacggttccactgatgcgattaacggcggacagttgtatagtgtgattgaaacattcggcaaactcggcacggatattcttggtgcgaaagtatatgataaggataaggataagagtaagtacggatttaaggcttcaacgtttgaaaaagtaaaatatcatcgagaacagccacagggacarggacaacmacaacmaactgccccaaaaacttttaaacaagccattgatgaaaccattaaagctgtaaattccggaatgaagttcaaagccggtgagggaaatggcggtagcaataatcctatcaccaaacaacttggcgacacgttaacattcaaaggagacgacaagtatatcaaggcgactgtagaggatgatgctattaaatacagcgtagaagtggcaaataacatagatgacagttcaaccccacctagtccaggtggagcaggagcaggaacaacagatccaaatgataaattagtaacagcaagtgcggtgaaaagttatgtcacgacaaaatttggtgcattaagttcaacgttgaatttagaaaccgatcaaccaactgatgacagtcaaaataaaggaaaagttgacttaaaaacaggtacattaaaaattactggggatgcaaatatccaaacctcaatagatactaatggtgaaaaaaaattaagtataaaacttagtgaaaatttaactaacatttcttccataggtaaaggtagtaatggtaccaaaatcacatttgatgatagcaaaaaggaaatcaaacttggatctgtatccgtaagtgtaaatgatcagcataaaatcgtaatcggtgaaggttccaaatcagaatcaaaccatacacttgcaatagggaataaagccataataggtcaaaatgcaaaaggctctatctctatagccagtctaacaaatggtgagcaggggaatatacaaaacgccgaatgggcaatctccatcggtaataaaaacaacgtttcaggcggaaatgatattgtcgctttggggtcgaatattaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaataacaccaaagtatctggcggaaacgacatactagcattgggttctaatatttcaataactggaagtaataatggaagtgtagtcgtactaggtaatggtgcaaaagctagtgccgcagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatgtacttggtgcagagaaagaaacggaaaaagagaaagatggaaaaacagtaaaagacggctttaagaaatcagaatttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaayggyactcaaaacacaccgcactatctyggytcgaccattaatattgttcgcttggcaacgccnnnnnnnnnnnnnnnnnnnnnnnnnnnnnnnnnnnnnnnnnnnnnnnnnnnnnnnnnnnnnnnnnnnnnnaatttaatcacgcaatatagcaataccgatggcaacgccaaaatcgaaatcggktttaaaracgcaccgaaatttagcaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgatggtaaaacttwtsaaatcggtcgtggcgatacgttgaaatttacgagtgatcagaatattaaattgactttagagaagaaaaatggggcaacgtctgctagtagtgcaacagctccaaccgctgcaccagcaccaacgcctgcaccaacaatggcaagcggttcgtcaggtagtgcaagtacaaacggcggtggttcaaatagtatggcttcgtcaggtggttcaaatggcgnnnnnnnnnnnnnnnnnnnnnnnnnnnnnnnnnnnnnnnnnnnnnnnnnnnnnnnnnnnnnnnnnnnnnnnnnnnnnncaccaaccaccactacaccaacaacggctgtggtaaccattggcacgactagcgatttgaaaaatataaaatcaatttcctcaccgtctaaaggagcgaatgcaggtacaggcggaagcggaagtgcgggcggaaattcaggtgccagttcaaatggagaagtcactaaacttacgttagaagcggagaaaggtgcgacattccaagtcggtagcactggtgcgaaagtgaatatcaataaagagggtatttcacttannnnnnnnnnnnnnnnnnnnnnnnnaggatcaagtggagcagatccatctgactcaccatcaatcactattaaagcaggtgcaaaaccagtggatccaaagagcttagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacggcaccgttgcaaccaacaaaaattatgttgatggcaaagtggaagatctgaacaataaccgtccatttgatttttatttagacaaggaaaaagtcgtgaaagataaagatggaaatttccacaaagaaaaagaacctagcaaaaatcttactgaggaagagaagaagcaggtcgtgatcaaagccgaaccaagcaccgcacctattgggattagcaatgtggcgagtggtctaggactaccagcccctgaaaaagatgaggaagaaaagaaaaaggcacagcaaaaaaacactgaactcaccaaagctgttgaggaaaaagtgaaagcaataggcgaaaaagctaccgcactttcaactacagctcaaaaagtaaccgatttaactttagcagtcagcggtttggaaatggcgatgaatgcaatgtctgagggcgaagaaaaaannnnnnnnnnnnnnnnnnnnnnnnnnnnnnnnnnnnnnnnnnnnnnnnnnnnnnnnnnnnnnnnnnnagcaaaaactgctttaaccgaggcacaaaaaggcttaacaaaagccaatgctgactatgaagccaactacaagggttatgaaaaagtcgctgccttagtcagtgccgatagtaaagccgaattaaccaacgcagcaacaatcggtgatttgcargcggtagcgaaatcgggcttgaaatttaaaggcaatgatgacatggaaattcacacagcattaagcggtacttttgcgattaaaggtgaagaaggtgcgaatggcaataaatttaacagcgaccgcactgctgccggtaatatcaaagtggaaatgtctcaagatggcaaagggctkgaagtcaaactgtccgatcagttgaaaaatatgacctcttttgagacacgtgaagtggasggkagaaaatctacgctaaacagcaatggtttgatagtggtcaataaaggtgcagataacaaagtcaaatcagcaacatacggtgcggaagcgrtggtgttgtcgaatcaagaaaacggcaataaagccgtggtgaccgctggcggtgtccattttgccactacccaagccccagcgacaggggctcgtgcggggacaggcgtgattacaggcttaaaagacctagacgcacgctcgacaggcgacatggcaaccaacaaaaactacgtggacgaaaaagttggttccgccgtcaatcgcttggataatgcgatcagtaccactaacagacgcttgcaggcgggtatcgctggagcattggctacaggaggattgccgataacggtgatgccaggtaaatctatgttggcagcgtcggctggctcgtataaggggcaaagtgcagtggcattaggctattctcgcatgagtgataacggcaagataatgctacgcctacaaggtacaagcacttcaacgggcgatgtcggcggttcggttggtgtaggctatcaatggtagggttctaaacgccagcaaaactcaccgcacttattgataagtgcggtgggtttggtagggatgattagttaaatctcaccaaaacagtgaacaatgcactgtcccaaatattaaactaatttattctcttatgtctcaggcttaagatctaattttgccatgagcaattgatcgccatcttcttcaggattgactgttaccaataatttgtcaccgtaaaaaatagaatttgctcctgccataaaacacattgcctgcatttcttcagacattccttgacgaccggcagataaacgcacatagcttttcggcatggtaattcgagcaacggcaattgtccgcacaaattcagtccaatctaattcttgagcctcggcaagcggcgttccctccacttttaccagctgatttattggtacggattcaggctgaggatctaaatttgccagacttgcaattaaacccgcccgctctttgcgagtttcattcataccgacaataccaccacaacatacttttaaacctgctttcctgactttaccaagagtatttaatcgatcatcaaaatctcttgtgccgataatttctttataatgttcaggtgcggtatcaatgttgtgattatagtaatccaatcctgcctcttttaattcttccgccataccgtcttgtaataaaccgaaagtgccacaagtttccaaccccagatcttttaccgctttgataatttcagtaatttttccaatatctttcggcttcggtccacgccaagccgctcccatacaaaaacgccccgcaccacgagatttagctattttcgctttttcgacaatttcctccacacataataattgctgattttgtacgccggtatgataacgtgcagattgtggacaataaccacaatcctcagggcatccgcctgttttaatagacatcaatgtcgaaagctggatcgtttgtggattaaagtgctttcgatgtacctgagccgcttgatacacaagttctaaaaacggtgtttcaaataacgcctcaactttgcatacagaccaatattcaacgcaaggatgcagcgttaaagagggaatgttgatagttgtgattgtcatattcttttccttatataaagtgcggtcaatttcaacgaggaatttccctctctgttgcttgaccattttttatttcaactatgcgatcaattttatctatcacttcgctcagttgatgagtaaccaataataacgttaattgtttttctctacagaacttatcaatcaatgtcaacatttcctgacgtaaatgaggatctaacgctgaaaaaggttcatcaagtaataaaatcggtttatctcgtaacaaacatctcgctagagcaactctctgtcgttgccctcccgacaattctttaggtaaacgtgataaaaaatccgttaaacctaccgcacttgctactttttccagttgtttgatttcttctttgctcaacttcaaatccgctcttaaaccgatagcaatattttgccataccgttaaatgagtaaataaattatgctcttgaaacaaaatggaaacagggcgttgatgtggtgcggtataagtatgattttcaccatttagccggatttccccttgcttaaccggctcaaatcctgcaattaagtttagcaatgtactttttcccgctccgctttcaccaataatagcaatcttttcgcctagacttatatgtaaatcaaagtgcagagaaatattgggataatcaaaaatagtgtttaatttaatcatctttttttattcgttcaattaatataaaaatacatgtacaaaaaacgagtaacagcaatgcagttactgcaccttcgtcagagcgataactacctaattgttgatataacaaataaggcaaggaactaaaatcctgattcccgaataaagctatggcagtaaaatcccctaaggaaatagcacaagccagtgcaaaagcatatttaaatgatgcttttaaattatgccattcaattaaataaaatctattccaaccttgaatagccaaggattgcgatagtttttcgtaatgttgcatattgttgtacatcggtaactttagaacctgtaaaacaaaaggcatggcggttaagccattacatagtacgactaaagcaaataaatgatagtgggagaaatccatttcccttaagcgaataaataaacctactgaaataaccaagacaggaacagccagcaccagcattccgctatttaaaatactctgagataaaaatgaataagacaaatagtgtaaacggcgtgccagtaataataatgaaacggaaaataacatcgctaaaatcgctgataaaggtgcaatagctaacgaataacctaaagcctgccaaagttgtgattgctgccaaatttgccataaactttgtgcttgaaaagcggagaaaacaatatttattaaaggcaagctgatgaacaataaaacgcaattgatataaaaaatttgccagatttgtaccgctcttgactgcttttctaaccaaatatttttactatgcaataacacttgtggcgatttttgccataggctacccaatgcaaacagcacacaacaaaaaattacttgtaacaacgcaaataaagccgacttcgccaaatcaaattcaaataaaacggcttggtaaatagccacttccaatgtagtgtatttaggaccgccgcctaaggtgagaacaatagaaaaactggtgaaacacagcataaaaatcaagccaaaaaccggtaataattgttggcgtaaatagggaaattcaatcaaacgaataaactgccaaccacgaagattcaattgtgatgccagttgcctttgctgagtgggaattgtttggaatgtttgcaaaaacattcttgctgctaaaggaatattaaaaaataaatgtgcaattaaaataccgcttaaaccataaatatggggttgccacgttatgcctaaaaaggttgttaatttaaccagccagccgttatgtccataaactcctgtgataccaaaaattacaactaatgcaggcaacacaaaagttaacgaaaatagcttaagaatcaaaggttttgctataaacctttgatagaaaaaggctcgagcgaataataagcccaaaaaaacggaaagtaaagaagataaggtagcctgtccaaaactaaataaaataacttgcttgatgtaatcatctcgtatcagttccgtccatttataatcagtttcaacagtaaaaataccgctcaatactagaccataaaatgaaacaataaataaccacactaccaatccacttaatgagctgattggtaatgtggaaaaataacgccatgcttttaacaaattacttcaccaaacttgcttgccattgattaatccatttttttagttgctcagcagaaatattggaactgtcaaacacatttgttttgagctgatactgttttaaggcatcataatgtggctcaatagggtcagaaatcacagataacatcacgttatttttaacgatatgtgtctgtgcttgcggtgaaatcaagtaatccataaataaatcaccacaggcattttctttgtttgctattttggctgctaattcaacttgtaaaacgccgccttcagcaaaatctgtcgcttggtactgatctttttgttcatttaataaatgataaagtggagaggtgctataacttaatactaaatccgcttcaccttttaaaaatgccccataactttccgtccaacctttaccgacagtaacggtatgtttagctaatgtctgccaagctcgatctacctcttgttgtggatacaccaaatttaaccaaatgattaatccccgccccacactgcttgttcgaggatcctgataaataactcgtaaatcctgacgttcaaccagctcttgcaaagattgcggtggatttactaatttagttttatcataaataaaagcataatgcccgaaatcataaggtaaaaaacgtcgatcttgccaagaaatcggtaaagaaagtctatttaaatcaactttatgctcactaaataattcagacttgattgcctcttgtaataaatgattacttaagcctagtacaatatccgctttggttttcttaccttctaaacgcagacgattgaacaatacacctgaactgtcaaaggacacataatttacccgacattgcggatattgttgctcaaatccttgtttcacctttggacctgctccccaatcggaggaaaaacttttataagtataaacggttaagccttgtgccgatttcgcttccgcttgagcaaaagagcaaatagacatcgcagaaagtgcggtaaaaattagagtggttttgaagttcattacttttctcctgtttgaataaacacagcatgataagtaatattgacttgattggaaaaagaaaggagtaagaccattagtttcctacgtcagtattaactgtatcaggttcacgggtattatctcagctgttatcagcaccccgactaagtcggacaatagtctattatatttttgttgaaaataacaaggaattttctcttaatctttgacttaacttcaagaacttattatgtctaatgtaatgtacaatttttttatcaaacattttccggcacaatacaacgctacactttttcaagaaattcaaaaaaataaacataatcaaaaaactcaacttgagcaagttatggattatgtttatcagatttgtcgttttgcttgctcatatacaaaaaccgaacaccatcctcttattaaaagtaaaattagaattttaagcaaaacaaaaacgttcccaattagtaggcaggaagagtttcaagcctgtctaaaaagaaacgttttgaagttatgtcagattaaaagaaattatttaatcaattattttttttgtagttgaccacattaaagaaacgtcttccttcttgctttccggcatagccacttttttgccaaaaggcattcttcaaccaattctcaaactgctgatgagttggaaatgtcatttcaccaaaattcggatcaaagaaaataacttttgagccgtcaaccgccgcagatacagtgtgagatcctccctcaagattaatggagattttcttaacaccggcagtatcatcgcctgtatccaaaatcgcttttactaatgaggatacatcattttttgatacagttcctgatacttcatcacgacgaacaaaatccgctacttttttctctttcggaacaacaccttgctcttgcaaccaactatctgtcaatttgaattgttgagtcgcactaccgctattaataaactcagtttgaagttttttaatagaatcaatagtttcttttttcaagtgtccttttttaccaccttcataaagggtattaaagaaattctcgtcggttggattaacattttttgcaatccaatgtgcacaagttgattcacacacaccattttgtgtttcaatgtgttttacaatttccttgtaaacttctcctttagattgggcaaacttaaagcttacttctccaccaaactcttcaacggaagaacgtacagcatcaattttgcttttcactttcaaaggctgaaattgatcctgaatgcgttgcaataccgtgcgttgctgttccactaaatctttactgctcaccaaatcactaactggtttcgcttttgcctgttccgtttcagtcactgtttcagaaactgtcgcagatctaactgttccggaactcaaagcagccgcattttctaccgcactttctgtcaaatccgtagaagtgcggtcagttttttctaaattctgcccgttatcttcctcgcttcctttttttgccaactcttttaaaaactcaactaccacttcactgctcgttgcggatttagttgatgctttcgtttgaggaataatctgcggttcaaactcatcactaaatttggtaaatgccggataacctgcgtcaagtaaaattttatttactatgactctcgccatacgtccattaccttctgcaaatgggtgataagcaatcaatcgctgataaactaatgcccctaccacgctcggctcaattccttcacttttcgctcgattgataaaatcaaccgtttccgctaattgaatttttgccgcttcgggactagaaaataccgcattttctttggttaaattctcttttttataaagtaaacgaccttctccctcatccggacgtaatccgtgattaagattctcgatcatctgcactgtcaaaggtttgccttgactgttttgtaagaaatcctctattgctgtcttcaactgttctttcaactccggtgtacgttgaatggttttcgacgtcgcagctaaagcttctgtgatttcatttgtttttgttgaaagatcctctataacctttgttttcggtaacgttttcaccaaatcttgaatttctgaaaactcctcaacagaagggcggaatgtgattgccttattaatacgactttctactttcttagctccctcggtaagaatatcatcaaattcaggtaaatgagacatttgcttaactgtcgcttcaggaattgatttcttcgaaatctctcttgcttcatctaaaaatttctcatttttcaatacattactttcaaaattagcatttcgatcatcttctaaagaaattaatccttttaagttcaaattatcttccaaatcttgataattgactttattcgctgtctcatctcccgctacaggcttcgcaccgcccttacttccggtgaaaaattgtttcactcgttggaaaagtgtggttttttctttttctacacctgtagccccctctgatttctctgctacttttttatttcctccagcagcatcttttagttctgctggtacagatgacaacggtgcaacttcatttacagaagtctccactttcggaacagatggtaactgaccacctgctttaccttgttccggctgtttaatggtcaaactgtctgcggattgtgtgttttcgacttcactaacatctttagacttcaacgtaacaggcgaagtcgcttgtccgttttgattattcgcacctccctcttgcggagatgattttttacctaattcagtcaaaaactctttcacaacttccgcacttgttgctgatttagccgtagcttttgtttgcggaatgatctgcgtttcaaattcagaactgaatttagtaaacggcggataacctgcatcaagtaaaattttatttactacaactcgagccattcgaccattcccttctgcgaacggatggtacgcaattaatcgctgataaaccaaccccgctaaaacacttggttccacattttgcttgattgcttggttaataaagtccactgtttcatttaactgaatttttgatgcttgcggactggaaaataccgcattttctttagttaaattttcctttttgtaaagcaaacgatcgctaccttcatcaggacgtaatccatgatttaacttttcgatcatctctacagttaactctttgccctgactacttttcaaaaattcttcaatcgcaccttgaacttcttctttcaattttggattacgttgaattgtttttgacgtatctgctaaagcttctgtaatcgctaaagtttgtgcattgagatcatctaccgcacttcctttttgtatatttttcaccaatccctgaatttcattaaattcatcaacagacggcttgaaagttaaggcatcattgatacgtttctctactttcttcgctccctctgttaatatttcatcaaactccggagaattacccatttgtttgattgtagcttcagggatgtatttcttagcaatctctcttgcttctgccaaaaattcaggatttttcaatacattttcttcaaaagaagaaccacgtttatcttctaaagccaataaatttttcagatttaagtcatcttccaaactatcataatttggtttagaagcagtttcctgttcagattttgtttctttagcctgtgatttactcgatttcgcaaagaagaaatcttttactttcgcaaaccaagatttctcatctgattttgcttttggcgatacgccctctgctccttctgattggagtttctgattaccgttattgttgcgattactttcagccaacgcacttcttggtgtacctaatacagctgattgtccattttccgcaactgtttcattgcttattgaatcgctcaaatttgatgggcgtggcggtaattcaggtgccacatcatcttccactctcgcttttacaatcggatttgccgctgccgcttcatcaccttttgctttcgctctcgcaagcccttccggacttttatccaatgttgcataaatcggctcgtttacctctggttttgccgtatttgctcgatcttctttagattttaaccgagcttttaattcattaaccagttcatttacaaccgcattttccgccggtaatgcacgtttcggcgtttgtggctcggaagacaattccgatggaatcggttcaaattcttcaccgttcgactgaccacgtgccgatctcggctgtattgatggagaggtaatttcagcataatctccctctactgccgaacgttctgtacgcaccgctgtttgcgatggttcgtctaacggaattgtctcataatcactaacttgaccttttgcagatctcggttgtaacacctcagcaattgtcgcataaccatcttcaccctctgccgatgtgcgttttacaggtgctgtttcttgtggtgctgtttcttgtggtagtggaatttcctcataatcgctacttccctgctgacgagatgctctcggttgtaacggcgaaacctcaccaattgtagcgtaatctccaccatctaccgcaactttaggcgtagcctccggtattgccggtaaatcacgttttgctttattcgctctatttacaacatcattaatgtcggcataaatatgatctgccgtatcaacttcctgagttaaacggaaatttggaagtgccggcagaggatcattcgcactgcgagttttagaggtaatttccgaataaatttcattacctacttcttccactttgcttaacaagcttctcactgtcggtaattccggcaattgatcactcgcagatcttctcacactgccgtacagcggattatccaccatttcaatgttagaagatgcttttggtttggacaatacgctgtaaatacttccaatcgtatcataaacatgatctgccaaatccgccccctgacttaaacgagttctaaactcatttggaagaggtggtaacggatcattcgcattgcgggttctagaagtaatttccgaataagtgccattacctgcttccgtgtcgctattcaacaagtttctcactgtcggtaattccggcaattgatcactcgcagatcttctcacactgtcgtacagcggattatccaccatttcaaggttagaagatgcctgcggtcgggacaaggtactgtaaatgctctcaatagtatctgctagaactttatttctcgtcccttcaccacctaaaaggctgtaaggactatcactttcaccacctaaggttctatttctaaccgcacttccattacctaaaagactgtaaggaccttcaccgatttgttcgtaaatatgttcctctgcggcttttggttttcctaaaagactataaggacctgctgcaatttcatcataaacatttgatctgatacgagaaatatctgaatttgcatcacctaccgtactgtaagtgctatcactttcaccgcctaaagttctatttctaaccgcacttccattacctaaaaggctgtaaggaccttcaccgatttgttcgtaaatatgttcctctgcggcttttggttttcctaaaagactataaggacctgctacaatctcatcataaacatttgatctgatacgagaaatatctgaatttgcatcacctaccgtactgtaagtgctattactttcaccacctaaggttctatttctaaccgcacttccattacctaaaagactgtaaggaccttcaccgatttgctcgtaaatatgttcctctgctgcttttgttcttcctaaaagactataaggacctgccgcaatctcatcataaacatttgatctgatacgagaaatatctgaatttgcatcacctactgtgctgtaaagatcatcgctattgttacgtaaggttctacctttgttagcgttgctatcgcctaaaaaatcgtaagcaccttcagcactcactttgtcataaacaagctcatctcctaatgctttcacttttcctaagagactgtaaatatcatcgctaccattaggcaattttcttcctttattggcattttgatcacccaaagtgctataaccttcacttgcctcatcagaagttcttagtttgcgtacatcagcactagaaccgtaaagcggattatctaccatttctgcaacatcttccgaagaaactctagttgtagtcggcaattcggcagcattatttcctgctttgctaaacttagattgtaatttagattttgctttttcacccaactctactaagtccgccacttcaaaattgaattgtgtacttgcatatacatcatctctcgtcacagtcttcgctttacttagatcatcaacaatttcgcccgttacattattatctttaagattgattccggaaataaccgatttttgtaccgcatcgtaatgtttttgctccgcacgtccaccacgagcattaaatgaagaagcaccacgctcgttaatacctacagaaacgccgacagaaccaccatctttatgatggctatcattgagttgttggctcgtaacatttcctgaaacacggaagccactattttcatctttattgatgaaatgagccgctacaagatccaaatctttaatttgtccggtaattctgttcgcaacaatacctgcctgctgattaagaagttttctgttctcaacttcatgagtataacctgccccaaaacttccattaccttttacaagtgtggaactagaaagtgcggcacctgctgaagcactaaaatcaaaacctctataaagtctatcgaaggaatcttgttttgatacaatgttcgttttacctttgatatttaaatccaaatgatccgctttaatatttgagctaatcaaattaagatctttacctgctgcaatttttagatttttcgctctcagcaagctgttgttatgtgtaactgatttttctgtcgagaaactttcattgccatcaacagaacccgatacgccaccattacaacctccgctcatcacgctacaacctgaatttataccaaatgcaaatttctgacgagattgtctttcagtactttctcttgttgtttcgccatcaagtatatcaacattacgtttggcttgaagagtcagcttgctgttagcatcgctttctacatttttcaactgtagatttccaccatgggctgaaagcgtaatattacctgcaatttttgtgcgaatgtcagaggtttccttaaccttatttgtttcgtaattacgctcaaatccaaacttagatgaaccgccgaccaattcgccggtaacaatatttgcaacatcgctaatgtgttgcaacgcaactgtaccatcttgcttaacgcctcgttgtgcctctacaatttctttcgctacatgactaacagcatctgcaatagctgagtgcccttctgtttcaataccgaatttcaagactgaacgttcagaatcaagatgatattcatctttttgtttattcgatgtaatctcttttgcagaaagttcaaagccttcatcttctttaactttcttatatttgttgaataaatcattggcagatttttctgtcatcaaatcatcaacttcactttgagatagaactttaaatttaggttcctctttctgagctgcgttgtctgttgcatcaggtgcggcttttgccttagcctgttgctcagctttcgcttcatcttcctcgactgcttttcctgtgaacttatgcttgttaatatcaacaccaccgatttccgcttttttcaatacatgtaaaataccatgatcgacctgcaaatcgctgttggtgtgagttaatgatgtttctttttctctcgtttcgctgaaagaaccgcccaaagtaaaaccagtgccagtattagacgatgcaccaccaatatttgttttctctccattttggctatcacgttcatggcttacagtgaaccctgcaccgctaatatgaccggatgaatattcttgatccaagcgaatgtaacgttccgtctgttgtgcattgcgacctgccttggtgttataatcaccttgtacaactccagtaacaacttttgccttgatcttactgccttcctgattcacatcattttttatagcgaaatgtacgtgatcaaattcggtatttgacccaacggaaattgctttttgcgtgctttccttacgatagcccaatatctcgcctttcttagagaaaattctacccttttcaacggaatgctcagttctgtgagtatctgtcgtattaaaattacgagctttcacaaaacctgttttacctttaatatccgatccttttgaattaatatctgaatcttcatctgcttcaaggtgtaaatgtccctctgttctaattgatgcacgttgaacttcaacatcgccgtttccattcacaaaagagcgggcagtattatcaattcctttatgtccaactaagcgagtgctttcctcacttaaaatatcgcctctatttttgattttattttcggcttcaatatcaatatttttgccggaaatcgtaccgctgtttagtacatctcttgttttcacattaatttcattagcacgaataagtgcatcaccaagccctttgaatttttcagcatctcttaatgttttattcgcaaaataaacttgtggtaacagaacctctttattgttgatatttgctttaacataccaaacaatgtcttgtttaagttgattttgttgttcttttgtcagtgcttctccaacttttaaacccaattctttagattcaaaataagagttatctattaattttttaaccaactgtgcatcatttacttgatatttcaatgccaaatggttatctactttcttctcaatagattttgtaattaactgatgttctaaatagttatcaccaattaccgccactttcttaccggcatcggtagatgaacctactttatttaagaaatatttagatccaaaatattcatcttggttaatatattgcaatttcgttctgtaaagcggatcggtttccactttaggacgtgtatcatctacctcttttaagaattggtttttcgaaagtgcttcttcaatttgatgatctttcgccagctcttttctgtattcttcaagacgtttttcttcttcaactttcgcttgtgcatctgcttgtttttgctcttcttgtttttgcttctctaaagcgatttgttgtttttcctcatcaattttgccttgtaatttcttctcttccgcaagtttttcggtttcttgctgagcaatttgttgcaactctgcttgtttttcaagtgcacttttctcttggcgttcttcytcytytttgtaacctgtttctagttcactttgtactttttcattttttgtttttgcatcaagagcttcagcttggcgtttctgctgtgctttctctttatattcattgaatttttgacgtaacttttcctgtacatgatcaggtaaagtatcaaaacgatctcttgtttctagccttgactcagttttataatccggttcgtcaggctcatcgggttcgcgttcccaatcatcagacacctctcgaatatatgttttttcaccaatttcatccaataacttatctaagaattttccattctctgataattcgttttcattcaataaatcaggttcttctcctgtgtgaggttttaatagaaattcatcttcctcatcaatctcaatatttttatcgaccgttttatctaactgtacgctgttatccacaaaaagatttggaatagataacaaatctgacaatgcggataaatcaacattgctattattcagattttcttttccattcacttccgatctaaactctactttacttaagtcgaatttatgttgtcctacagtgatttgttcattttcagaaaatcctccggttgaaccattttctaaagcatccacagttcccttaattctttgagcaagaattttagctttatcagttgggcgataatcaaagtgggcatcttgtttttctttaaatgatttccaacgttctgacaatgttttatggtcttcatttcgccaatccgccccaaaaacttgaaccatagccttttggaaagtatccgatttaatgtcttttaataagtgcatagcttgcgagttatccgcataataagaactggaatttgttattggttgctcagaaaataaaccgtcaaaaagctcctcaagagaattgaattttctctctgcttgccctgaaagtgcggataaaaagagacgggctctcggctgataattaaatgtaatatcttgtttttgtttgaaaaattcagtcaacaaattggcttggtaagccttcatattatttacaactttcgcattttgggcttcgaaagtgtttttaacattaatcacaccatgattagtgagtattgcctcttgttgattatctcctttcttaccttcgaatttgaaattcccttccgcacggatcaaacctgctttttcgactttcacctctgcttctttaaattctaccggattaatccataaacgatagtcgttattatgccaaccatgacttgcaatatcagaacggcgataacgggttaatacggaagaatttgttcctttactgattttgcccgatagttgaacatcattaattagttcattagcttttacagtaaggtcgttcttagcgaaaatattacccaagttgtaaacagtattttctgcatcaagatctatcttactctcagaatgcaatagagaatccgctccattaataatatttccttcagtttctttattatttcctttagcagataaagtcagttgttcacgagcacctaaaatccctttttcattatagatactaccttgtttagcattaatcgtcagcgtttttccgctggctaataatccgttgttaacaacattgcctttagcttcaatggtaagttttgcagtagtttgtagttcatcattttcgctaataaccacatttttagcatcaatagtcaactcatctttcgcttttataaaatggttacctttgctgacaaaacttgtaccatctttaaaagttaatttagctttagatttactttcaatggtaccggtattttcaaaaccaacatctaaatcagcaacggtttcttctttaacgtccgccttgcgtttattgtctttattgacagaaacagtgactttcttacctttggttttaatatccaaatcattttctgcgtaaatctcttttttattgactaatttatcggtatcaattgttactttatttccgtaaatacgcccttggttagtcaatgtttgagatttaagctcaagatccgttgcaacgacttttgtctcgtcatccaacacaagcgatttagttacctctacttttacttttttagaggctaactttcctttaccttttaacttagcttcctctgtggctgatgcctctttattattttttaacttaacatcatctgcggttattgtgatagacttatccgccgtaatctcatttgcaatagtaattcttttagctttatctaatgagatatcgcctttggcacgcaactcattacctaaatcaatatcccctttgttgctttcaattttaatatcgttttcagataaaataataccatcgtgttttacacccgcaccttgatccgttacgatcaatttaatgcttttaccgtgcattgcacctgtacttgcaccggtaattgcgacttcttctttatcggaaggctgactggtattactatctttttgtacttctaattttgtcttaccatcattctcaatgttatatgtgcttttaccttttcctgcaataaaggtaatttctgtttccgatggtttgttcttttctttctctttatttccaattgtgcctttttgttcaattttcttcgcaacaatatctaagtaaggtaaattatccgttgcaaacccgttgacatctattgttactgttccttctgaaacatctagatccatcttgttaggatcgataagcttacttgtcgttgcaacaaaacgtcctgcgttaatggtttgcaccccatttaggttaataccatgttggttggcaataaccaaatcggcttttgtacctaaaatttccaacgcccctttaatttgactaagttctgaacccgttacctgatttaaaataactttcgcttctttgtctgctagattcttattaccttccagataacctactaattcagaacgttgttgatctttattatttttaaacaccgctccatttggaatattaaatttttggaaacggttatctgaaattcctttatcattcggtttcgcaatatcaatcacgataacgttattttctgttttgtatagtttagtgggatggttgttttcagttgtacctgcacctacgcctgcattttgattcttagtatctaattggatactgtcattaccatttttaatttcagttagctgaggcgttttctccgtttctgtcgcttcctctgctgactgtgcaaaattcggtgctgctaccatacttaacagcaatacagaaacgcttttccaatttaagcacaaagcggaagataccggatttaaaaaggtttttacggataaacatacgttggataagcggtagtcttcaattgatccctgccgatcttcctcgtctgttttttctgacacaacaacagaatcagatgaaccattatctatagcagatgtaatacattccgctacaggaactaaacaacctcttgtcttgctgaaaataagcttataacaattcttattcataataccttcctctaaactaaaaaatcaaaacgaaaccgaacctgtgaaataaaaaaccgacttcttgttactttcctcaaaagttcccactccattaataggcttagcataagtcaatgataatgcaagtgattttatttgagctttcacaccgaatgcaaaccccgcaaacgtatctacaacatggtgcggtcgttttgcatgaacttttcctatatcaatacccaaaaaagggttaatgtaagataaataactcttttgagggtaaaaaggaagcgtaactgtttgagaaatatagaaaccacgatcacctgagcctgccccacctttgaatcctcttaccgtatattcatctccaattgagaactggttctctccatataagctatcaaatccatattgtgcacctaaacgaaattgataactcattcctcgattaaaaaaaacaaacggtctctgccagttaatactgcctgaaaccaatcttaatgttttgtctctatgtgaattatatgcagaatgatttgcattaaaccacctcagtccattggaataagacagatcactataaagtttgccatgccccaaattggtcacataagataatcctatattcaatttgttattgtgatatttccctatgcgaatatcaccaaagtagctaagacgccttttaaactcaagttctccatataaagataaaatcatgtctttattacgcaataatgtgtgcgataacttaaatgacgcctgctttgtttccccactggatccgtgagtatgaattcctctcaactgtttcttataaccggaatatgataacttaatatccaaagtcgaaaatgagaaaggttgagtataagacaaggaataattttgttgccgatttacttgacgatccttataaatacgataacccgttgaaaaactccaacggtcattcgttcctaacagatcactccatgagatgcttaatgttgcctgatttcgaccttcggcattacttccttcaccggaattattcaggcttaaactaacctgcggataagaagtgcggtgcctctcaatgctcaaatttgacatacttttctcattcgctgcaatcacattcacctttgctgtcttatttcccgtatttagaatttcgatcagctgatccacgtcgtaaatacgaagtacctttccttttaaattaggcaaaacaaatagcattgctttatctttgaacaaagaagcctgctgttcttccactaaaatatcatttacttttccccaaagtacgacaaattccacttcaccgtttttgatctttgaagattttaaaccaatagcactggttacataaccggcattgtacaatacttgtgttagctcttttgtcaacgcaaacacggttttcgttgataaaggctgatttaaataatgttttatgacttcatcaaaatccagtgagatttcctctccacccaaatcaatagtaatcttcgtaattgtttgtatcgccgttgtggatttaagttgagtaactatmtcctcttgatttggtcggttatcctccaaaaaacgttgtgctttctcgaaattttgctcaactttttcaaattgttgttgattttttaaatgcaataactcttgaaccaaaggcttagcctctttcgctgcttctcttgcttgcgtaaccaaaggatcttcttgtgcttgcacaactaaaggagcagcaacaaaagaaactagtaaacagcatgaaaataggatatttatcttgttatatttatattttggcataaaacgccgtccttccactttaattggaacaaattatactatacgctatttagacaactggtaataccagtataaatcattcttagcaatttcatcgtgtctttttcataatttttcataaaaaaatccccctttcctgtgctaaaaagaaaattgattatactgtagtttttatactattgaatggaatgaattacgcagtaattactttcttatttttatcttcgttttatcataactgtcattttcattaaataatactaatttcctctttaaatctctccttttttcgagtagattaagagttctcctcaaaaaattaagtaaccataaggaagaacattatgttattaactaacccagtagtaatttccattattgtgttactcgccttaagtcttatgcgaattaatgttgttatgggattagttatctcagcattagttgccgggctatgtagcgatttaaccattaatgaaacaataaaagcgttcacaggcggtttaggcgggggggctgaagttgcaatgaactatgcaattttaggtgcttttgctattgccatctctaaatcaggtattaccgatctacttgcttttaaagtaattaaacgcttaggtaagtcgccaacaggtaattcaatggctggatttaagtactttattcttgccatactagcgttattctcaatttcttcgcaaaacttattaccagtacacatcgcattcattccaattgttattcctccactcctttcaatttttaataaactaaaagttgatcgtcgtgcggttgcttgcgtattgacatttggattgactgcaacctatatgcttctccccgtcggtttcggtaaaatttttattgatagtgttttagtgaaaaatattaatcaagtaggtgcttcactcggcttaaaaaccagtgtagcagaagtctctttggcaatggcaattccggttatcggtatggttatcggtttattaaccgcagttttcgtcacttatcgtaaacctcgagagtatgtttcaggcggtttaaatgctacaactgaagaaatcgaaaagcacattgcaaatattaagcctttccatgtgattgtaagtgcggtcgcaattgtactcactttcgctttacaactgataaccagttcaacaattatcgctggtcttgtcggtctcattattttcgcagtatttggtatttttaaactaaaagaaagcaatgatattttccaacaaggcttaaaattaatggcaatgatcggtttcgtaatgattgccgcttcgggctttgctgcggtaattaatgcaactggcggtgtaacaattttggtggataatttcagccaaggcttgggtgcagaaaataaaggtttagctgcatttcttatgttgcttgtaggtctatttattaccatgggaatcggttcatccttttcaactgtaccaattattacatctatttatgtaccgctttgtctttcctttggattctcaccgttggcaactgttgcaattatcggtgtttctgccgcactgggcgatgctggctcaccagcctcagactcaactttaggtccgacatccggcttaaatatggacggtaaacatgatcatatttgggattctgttgtaccaacattcatccactacaatattccgctcattctttttggttggattgcggcaatgttcctttaataacttactttgagtgcctatggcatggcactcaaattttttaacttatgcaacaatctcctgttattatcttacttaaacaaaaagttgacgagtttttctctcgttattctcatataccttccaagcaaaaaatctatgccaaatttgaccgcactttatttagccaagactttgagagtttgtcgttttacctgaaagaaattcgtcaatgtttaactcaattagaaaaaatcaatgatgataatgtacaaaaatatactttttatagtgaaaaattaaaaggacaatgtaatgctctctcagaggcgttatcacaaacgaatgctaaaacaaacatcaaatttcagcataacgatacaagtctgcaatctgtacaagagcggcgggaaaaacaaagaattgcactgaataaacttcctccaagggagcgtttaagtaaatattatgaagcattacaggctttaaacacaaaattagaacgacaacgagattgctttgaagaggctacattattacaggataagcaaacctacagccaacaaatcgcaattacacaacaacgcaaacaacggtgttctgaggctattgaacaactggaagaatatttggctttattagatacaacctcagagaaataacgaaaatataacgaaaatatttcacaagtatgtactatttttgtttaaattcttgcattaatcgcttgatctgccgatcattctttttaaatgctcgacaataaggacaaaataataaatgaatattaattgcacatttttgatagaacgctaattttttttcattactcaaagaaatcaattcagtaatttctttacaatttttcatctattttttccctccaaaccaatttttagataaacatgcctgtaactgaagtctagctcgatacaacaatacatgtaaattagacgtagaaatctcacattcctgacaaatttgttcgctatccaattctaaatactctcgcatcataaaaatgcgagcttgctgagctggtaaccgatttaaacaagcatcaaaaataacccaaaactcctctttataggtagcactttgaatatctgaccattcattaggttcaaaatggtttaaatcccaatgtcctttatcgttaaaaaacgcatttggtgcatcttcttcacagatttcagaaatattaatcattcgattacgactatgaattaagtcaataattttattttttaaaatggcaaatatccaagtttttaatgcagatttcccctcaaaagtgcggatattttttaaagcatttgttaatgcctcttgtaccacatcttcagctaaatcaaaatccttcagttgcaaaactgcaaatttgaccatttgtaagcgaacttcttcaagatccagttgagaaatatgttttatttcactcacaatcgttctccttgacaaaataatgtaagatttttcatcattctctgactatacaaattatacgtcaataacataggatttaagaatgaaaaaattaacttctcacgatgttacacctgaagaaattttccaccaacgtcgtaaaattattaaagccttcggtttaagtgcggttgcgactgcgttgccgaattttagctttgcacaagacagtaacggcttgaaatcccttgaatataaaaaatcgacagacacaactttaattttaacgcctgaaaataaagtaaccggctacaacaatttctatgaattcggtgtagataaaggttctcctgcacactatgccaaaaattttcaagtaaacccatggaagctggacattggaggtgaagtcgaaaatccttttacgcttaactatgatcagcttttcactcaatttcccttagaagaacgtatttatcgtttccgttgtgttgaggcttgggcaatggtagtaccttggattggttttgaactcaataaattattagaaaaagccaaaccgacaagtaaagcaaaatatgtggtatttcatactttgtatgatcctgagcaaatgccaggacagaaaaatcacttctttggaggcggtattcattatccttatgttgaggctcttaccctcgccgaagcaatgcactctctcacgttaatgtcggtaggtttgtacggaaaagcattaccaccgcaaaatggagcaccaattcgcttagttgtaccttggaaatatggctttaaaagtattaaatctattgtcaaaattactctatcggaaacacgcccacgcactacttgggaaagccttgcaccgaatgaatacggcttttatgccaatgtaaaccctaaagtggatcaccctcgctggtctcaagcctccgaacgggtcattggtgccggcggattattaagtgtgaaccgacaacctacactcatgtttaatggatatgaacgagaagtggcacatttatacaaaggattggatttaaggatcaattactaatgttggcattattacgtattattattcacttgagctgtttagctccattaatatggctttttttcgtacttttttcaggaaatgaaaccgcacttggtgccgatccgatcaaagaaattgaacatttcttaggctatacagctattttgattttctgtgctatgtttttactcagtatcctattgcaactattgaataaaaaccaataccaaattttacgccgtcctcttggtttatgggcatttgtattggcattattgcacgttgccagctatcttttcttggaattaggatttgatttctcattattcataaatgaaattataactcgtccttatctgattttaggcggcattgcttttctcattttgtcagtaatggcaataacatcgttgcccaaaataaaacaatggcttggtaaacgttggtttcaaatacaccagcttgcctatatagcaattatctgtgcggcaatccattattattggtcatcaaaaagtgtaactttagcaccgattgtggtaagcctagcagtgattgggatcgttatttggaaatatagcggaaaatatctcttaacatttttgcataaaaaatagacattttattgtataaaactctcctgattttcaccgcacttttccgctaattgaatgatcacttcatacaaaaagcgacaactaagtgtcgctttctacctttaagcaaaccatcctgcttgatgggcaataaataataatgtgaacgcagttaaatacactaaaccgattacagaaagccaaaataacccgcctcttatccgatgttcgccctttaatacaagcgaaagatttaactaggcaaaaataggcgttgaaacaaaagaagcaatcatggcaaattctaacattggaccgacagcattattgaagtaaaaaataatcgctaatccggaaagtgcagcaaataatatcgctaaatttaaggttcttaaactactttgttttttatttaaaattaaacgtaaacattccacatttgagcgagaatatccatcaattaccgtaattgttgtaccaaacatacacataaaagcaataaatgcaataagtgcttttgcccattcaccaatcgttgaagcatacatattaatcaattgtgcaatatattttccaccaaccatctgaacagtttcacctgaaccaaattggactagtgcgcccagtgcaagaaatacaatggctaaaattgcagtaccaatataaccgacattaaaatcccaaatgccgtcctcataagatatttttgaaatacggcgtttagcgactacccacattgaattgattgcagaaatttcaattggtgcgggcatccagcccatcaatgcaacaataaaagcaagtgcacttagactccatggatttggggcaatataatcttgcgaagcaacgccattaataccattacgcattaatgcaataattacagcagttaatgttgtcaatgttaatgcaatcataatgagtttagataaactatctagcaaacgatattgcccaaataacaaaataaataagctaacgccaataacaatcagactcaatgtaggaaccggaacagaaatcggtaatacaaaagttaaaatcgccgcacaaagcaagcctactgcggcagtattaataaccgttgaaaaaacatttaataagaaaaatacccatagataagatttccctttttggcgataaccttcaagtaacgtgttaccgctatctaaagtatattgcacaccaaaacgaaaaaatggatatttaaataaattcgctaaaagaataataatggctaattgccaaccataaatagcacctgcctgtgtcgacgcaataatatgcgaaccgccaacagccgctgaagccattaaaataccaggacccagtgcacttaatttttttgcccaaaaagattgatttacttgttgattttctttcataaaaattcctactaaccatctaacgaattaaaattctaaaatatttaaatataaaaacaagagaaaaataaaaaataaaattctaataaagaagatttataaacaaaaaataattatataaatccaaaatatttaactttactagattttaatgctattttttaaaaaataaaaagaaataaactctagaaattaagaagttagcaaacaaataaaaaacatataaaaagtaaaagcaaagaacacaatttctgtaacaagatgaaaaaccgaaaaataagatggctggggtactaggattcgaacctaggaatgccgagatcaaaacccggtgccttaccgcttggcgataccccaatagatattctaaatctgaattaactaagaagtgcttaagatagtatggctggggtactaggattcgaacctaggaatgccgagatcaaaacccggtgccttaccgcttggcgataccccaccaactaaagagttgcaagctaatgaatggtgcgggacgagggacttgaacccacacacctcgcggcaccagaacctaaatctggtgcgtctaccaatttcgccagtcccgcaaacatggtggctatgacgggattcgaacctgtgaccccaacattatgagtgttgtgctctaaccaactgagctacatagccatattatttgcattaccctcatcggctttgcggggctaattatgctgatatataccttactcgtcaactattttttaatgttttttttgatttcagtgttgttcgcatatagattatacaattcagataaaaagcatcttatactgtttttaataaccgtttatgattgatgtcgaataatccaacaattatgaatttgtttattccgttcaaaatctaaaggtaaagttttagcagaaatttctaccgcacttaactctaattcttgcaaaccgtctatatccattttaaaacctcgtttattattggaaaaaacgatagttccatttgttcgtaggatacgctttagatttgccattaacttaatatgatcacgttgaacatcccagctatcttccattcttttagaattagaaaatgtgggaggatcaacaaaaatcaaatcgaattgacgatcacatttattcaaccactgcaaacaatctgcttgaattagtttatgctgtttaccttcaatatcatttaacaacaaattctgttctgcccaatttaaataggtatttgacatatctaccgtggttgttgattttgccaaccccaacgcagcatgaaccgttgcagatcctgtataagcaaataagttaagaaaatctttccctacagccatttctcccagcattttacgggtcaaacgatgatctaaaaataaccctgtatccaaataatcagttaaatttacccataattttgcaccatattcatgcacataaaaatactctcccttattagcgagtttttcatattgactggtgcctttttgtttttgacgtacttttaaaattaatttattcgtttcaatacctgttaccgataaaatagcacttacagcatccaataaacgctgacgagctttattttcatcaacatttttaggtgccgcatattcttgtactataatatgatccgcatagcgatcaaccgccaaattgtattcaggtaaatcggcatcatataaacgataagcatccagtttttgttgattagcccatttatcaattttcttgatatttttacgtaaacgattagcgaaatcttgtgcaacttgtgtattttccgatacaaaagtcaatgttttttcttgcgaattttcaaccgcactttctacctgtttacgaacagcaatatggtaatttttttggacacaatctaaaggaccgttttttgccttaaattgacgatacgcacgtaaacgtaaacaatccagcaatacgggttctccactaaaaattgaaacgttccaatctgcaaactctgtttttaattgacgaccgaatacagaatataaagcaattaaagccggagtagtgcctaatctttcaccataaggcggattacaaatcactgttcctatttcttgttcagttggatttttcaatcctgcaacatcaccttgttgccatttaatgagatgtgagacccctgcattttgagcatttttctgtgctttcttcaatactcgatgatccaaatcaaagccccaaaagtgcggtgctaattttcgattaaatgcctgctctgcaagctcaactgcctcttgctttactttttcccatacaacttgattatgacctttccaaaaatcaaatccccaatgtaaacgatgtaattgtggtgctatctgagcttccatttgtgctgcttcaatcaataaagtgccggaaccgcacataggatcaacaagaggtgtccctttttcccaaccggaacgtaaaacaattgcagcagctaatgtttctcttaaaggtgctttccctgtatcttcacgataacctcgcagatgcaacgcctctccgctcaaatcgagagatacaactaactcatcttgatttaaataggcatgaatacgaatatcgggatactctttatccacatttggacgtgtttttccatgacgctcaaaataatctacaataccatctttaacacgcattgcaccgaactgagtatggcgaatttctctattagtaccgttaaaatctaccaaaaaagtgactcgttcatcaaaatgagtcaaccaattttgtccaacaatagcagaatataaatctaaatcactataaatttttgttgtaataagcggtaacaaaatccgagaactcaatcttgaccataataaaatgcgatactgcgtttcatcattcgcaataaagtgaactccaccttgtacaactcgacattcttgagcaccaagatccgttaattcaacttttaaaagttcttcaaaaccacgtgatgtagtagcaaaaagttgtttcattctatctctctataaagtaaaaattgggcgaaagcccaattaacattaatgattaaattgcgtgctatgtagctgtttataagcaccatttaaggctaataactcttgatgagaacctcgctctttgatttcaccctgctcaatcactaatatttcatctgctttctcaatagttgataagcggtgtgcaataaccaataccgttctatctttctgcaaagtttccaaagcggcttggattgcacgttccgactctgtatctaaagcagaagttgcttcatctaaaatcaaaaccggcgaatctcgtaataaggctcgagcaatagccaaacgctgacgctgtccgcctgataaactcgcaccgttctcaccaatcacggtatccaaaccattttctaatttttcgataaactccatagcataagccgcttcagccgcttcaataatttgctcacgagtacatttctctgtaactgcataagcaatattgttagcaatagtatcgttaaacaaatgaacttgctgtgaaacaaccgcacaatgttcacgtaaatttgccaaagtataatcttggatattcaccccgtctaaagtaattttaccttgttcaacatcataaaaacgagtaaccaagttggctatagtcgatttacctgaaccggatcgtcccactaatgcaacggttttaccttgcggaatagtgaaagaaatattattcaatgccggatgttcttttccactgtaactgaaagtaacattttcaaaccgcacttcccctttaactgtatctacaacatgtttccctgtatccttttcagtttcgagatctaataatgcaaataaagtctgacaagccgccattccacgctgaaattgtgcatttacgttagttaaagattttagtggtcgcatcatagcaagcattgatgaaaaaactacagtaaatgaacccgcactgagattttgtgtcatgatttccggtagcgttgccaaaaataaaacggcagcaagtgcaaatgaggctattatttgtacaaccggatcggaaattgcactagctgccataactttcatgcctctacgacgcatattattacttacttgatcaaaacgctcttcttcaattttttgtccgccaaaagctaaaacaactttatggccttttaacatttgttctactgaagaggttaaatctcccatggagttttgtaaattttttcccaattcacgaaatttttttgacactatacgaatgataatcgcgataattggaccaataataaaaagcaccaaagccaattgccagctggtataaaacattaccgtgagtaaagctatgatgtaagccccctcacgtacaattgtaactagcgaacctgatgaagaatttgctacttgttcactatcataaacaatacgtgacagtaacctccctaccgaattctgatcaaaaaaagtaacgggcatatacattaaatgcctaaacaatctacgacgcatcaccatcacaactttgcccgaaacccaagctagacaataagttgaaatgaaattggtgaccccacgaacaaatattaacaaaaccaccacaatagccattattctcaagagcgaattgtcaactttaccaaaaccttcatccaacaccggttttaacatttggatgagtgccgcatcagctaaagcattaaataccaatgctgcagcagaagcaattaagcctaatttaaaaggtgctattgttggccatagccgtttaaatgtttgtaatgtagaaagatctttatcttgcatgttcatacttctatcgtaaaaaaattgagtggcattatacatttatttaaattacaagccaattaatcctctataccaagggctaaactctgtccttgcggtttgaatttgaatatcttttcctttaaatgttaaacggatttggccggaaatggccgtattatagaccgcactttcaaccgcatttaagcgtttgacgacatcttgatgcggaaatccccacggattccaacgtccactggaaattaaagcaattttaggctgaatatgctgtagtaatttctcaccggttgacgttttactaccgtgatgtccgacctgtaacacatcaatcttacccaagtcagacaaaattttatattcagtcgccacatcagcgtctcctgttaatagtactttatgctgtccatctgaaattatcagcacacaagaatccggattattggctctcatcacaattttacttggcgataaggcttcaatatataacccctgccaatgccatatttttcctttttgacaagcaatatgcggtctattttctggagaattctcgtacttttttaatgagggactaataaactcagcattcggataagcttggaaaatatcttttactccacctgcatgatcattatcatcatgacttaatataactttatcaagaataataccctgtcttcttagataaggaataatctcaatttttgccatactaccatttttccagcttgctcccgtatcatacaaaattccatgttgattttttaccaataaacttgccaatccttgaccaacatctagagtatcaaattgccattgtgtgttttttaatcgcccttgttcatatagcgaaaaaaaccacagacataaaaaaataacaaacatagctgaactgaccaccataccatattgatattttttatgtgaaaaaccgtccgaaaaattcaaccgtatagggtaaaaacttttttttctaacttttctcaataaagataaatcatcgtcggttgaacacttaataatccatttacagcataaggtgaagagcaaagctaatatagctgaaataaaatagctttctgcaagagaaatattgatccactgatttggtaacagctttaacaattgattgatccatatagcaagctgatcagctatattccaactatttaacgcaccttccgtcagtacagcaaaaagaataagtggaactaacaaaaaactgaacaaaggcaacaataataaattagcccaaaatccatttaaggcgataccattaaaaattaagagttggataggtgtaaaaaaccacaaaagcccaaattgcaaatgaaaaagaccgataaaataccgcacttttttaaaggaagattgtgccaaaggcttttctttccataaaaataaatttagcggtatccattgataccacatgatcaaacagcctaccgctccgattgatagccaaaaactggctgacaataacataaatggattaagtatcagtaaaacacaaataacccgcaaaaatagttgccaaacattataggaaactcgacatatgcgacataaacaaactataaataaagcgacaatcgcacgaaaagtaggaattgaaaatcccgctaattctgcataacagaatgctaaaaaaatccctaatattaaaggaaaataaggttcaatataacgagtagggaataataattgaatagctcgccctaatgtaaaaccgatgaacatagctaacccaatatgcaaccctgaaattgcaattaaatgtgcggtattggtttgttgataaagttgccataattccttgtctagccatgctctttcaccaaaacccaatgcaagcaataaaccttgtgaaactaaattggaagtttgttgtaaagcttgattcagtcgagtagctcgccaagaaaaatcctcaccaattttcaccgcactttttactgtggcataagctgtaatttcttttgctaaataccaggtttgacgatcaaatcctcctatatttaatcgagaagaaatcggacgaatgtgcatatttacttgccaaatttcaccaacttgaacctcttgctcagtacgccaatttaaataaattcgctgtgttggcaaagatgaggtgaattttccttctgcgatcactgcttgatagtctttctgctgaataatttcagctattttaacgttagtttgtacttttttaggtaagcgggtaatatgctcactttgttccaacaagtttaatgcttgataatgaaaaaatcccaacccaagaacaaaaatgaaaaatagctttagaacacagcgaaaaaatactgctttaacaccaatatatcctaacccaagaacaagacataagatcaatatccattgccaattcaataaaaaaatacgaggcgtaattagcaatgtcattgcactcactaaaataacaaaaaggtaatgatcaaggttgaatttcattgataaattgaagattaattaattcttaatctacaatatgaaaaaaatacccataaaaaccaagtcagataaacttatcttggaatacaaatcacaaaatcaacaaaataatagaaaaaaatgaagagttaacataaatttatttgcttatttgagcaacttctgatatttatagcgcctttaaaatcagctgttccattttttggagtttttgaacaatcataaccagtttgcaaagtgctttcttaagttacaatcaattgtaagccacagaatgaataattattaggagatttaaatgtctaagtcatctttaagtttattagtgctcgccggcgttgacccttataaagaaaaaaaaagcgaagaatatatgaacgatgagcaacgttctcatttcagaaaaattttgcaggcttggcaaacacaaattcaggaagagacatctcgtactgtagcacatatgcaagatgaagcttcgaactttccggatcctgctgatcgtgcaacacaggaagaagaatttagtttggagttacgtgcgagagatcgtgaacgtaaattaatgaaaaaaattgaacatacattgaaaaaattagaaacagacgatttcggttattgtgattcctgtggtgtagaaatcggtattcgtcgcttagaagctcgcccgacagcagatctttgtattgattgtaaaacgttagctgaaattcgtgaaaaacaaatgatcggttaaccaattgatcaaatttggataatgtaaaaataaattttggaaacgttttttgatagttggtttgttagcttaaaagaaattttagaacataaatcaattgttagtgttaatacaaataaagtgcggtcttctctgccgcacttttgaatttttataaaactacaagatattaaaaaaggggtttattattttaaaatttattcaaaatctgttaagaaaaaaaaataaagtagctaaattaccaagctcaaatttgcctctaacagtttctacttcaaaacataaaactatctctcaggaaatgcgaactgagtcgccttttattgccacaaaacagcgatcgatacacaaaaatcaacacaataaatatgttgtcaaggcgtctcaatacggaattatgccacgtatgatcagtcgtaatgcactgtcagttgtagaaaaattacatcgtaatggttatgaagcttatattgttggcggttgtttaagagatttattattaggcaaaaagccaaaagattttgatgttgcaactaatgctaaacctgagcaagttcaagctatctttcaacgacaatgtcgtttagtggggcgtcgtttccgtttagctcatattatgtttggacgtgatattattgaagtggcaacattccgtgcagcacactcggacaatcataatgaacgccaagcaaaacaaaataatgccggtatgctattgcgtgacaatgtttatggaactattgaacaagatgccgaacgccgtgattttaccgtcaatgccctttattataatccgcaaaataatacattacgtgattatttcaacggcattgaagacctcaaagccggaaagttacgtttaattggcgatccagttaaacgctaccaagaagatcctgtacgcatgcttcgttctattcgctttatggcaaaactggatatgtttttggataagcctagccaagaacctatcaaaaaaatggctcatttattaaaaaatattcctccggcaagactttttgacgaaagtgtaaaacttttacaagcgggttatggtataaaaacttatcagttgttacgtgaatacggattatttgatcaattatttcccacgcttacaccttatttcaccgataaagcggatagctttgcagaaaaaatgattattaccgctcttacctctacagatgaaagagttgccgataacttaccaattaatcctgccttcttgtttgccgctttcttctggtatccgctaagagagaaagttgaaacactcaaaaatgaaggtagtttcaataatcatgatgcttatgctctagcaagtaatgatattttagatgctttttgtaccgcacttgccgcaccacgtcgtcatacaactgtcatccgagatatttggtttctacagcttcaactgcttaaacgcaccggttctgctccgatgcgagtcatggaacatgccaaatttagggcggcatttgatctcctcgttatgcgtgcacaaatagaggggggtgaggcaattgaattggcaacttggtggcatgaatatcaacttagtaaccaagatcaacgtgaaagtttaataaaagaacaacaacgccttaatccgaaaccgaagaagaaattttatcgttcaaaaaaacatcggaaatctacgctatcatcatgaagactgtttatatcgctttaggaagtaaccttgatacgcctatacaacaactaaatctggcactaggttcattagctcaactcaaaagttgtaaattaagtgcggtaagttctttttatcaaagtaaacctcttggtccacaagatcaaccggattacgtgaatgcggttgcttgtttaaaaaccgaattagatcccatagccctattggatcaattacaacatatagaaaaccaacaaggacgagtgcggttacgtcgttggggtgaacgtactttagatttagatattttgttatatggcaatgaaattatccaaaatgaacgcttaacaattcctcattacgatatgaaaaatcgtgaatttgttatcattcctctttatgaaattgcaccacatctcattttacctcatggcgaaaaattagcggatataatgctcaatttcactcatcatcaaatgcaaaaattataaaatttaaggcaaatatcataatatttgccttatttgctgaactaattttcaacttaaacattgttgaattttttttcgaaggatttgacgtcgttgactataaattacaataagttttccactcaccattcactgcggtaccaatcacgttaaattgattatcaaagacagttaagtttgcaatcttgcccacttcaatcgaacctaatctatcatcaacgccgattgcacgagccggatataaattacacatacgtaaagtttcatctagaggaacttcaacatatttcaccatattttctaccgactctatcatagtgaccgccgcaccgcctaatgtaccattagcgtcatagcattttccatctcgcacatagattgtttttccaacaaattgaaaagattcaatattggctccggcggcggctgtcgcatcagtcacaatacaaagtttatcgcctttcaactttttatccagtttgatattttcaaaactcacatgtaaaccatcggcaataataccgctataaatatcactatctaatactgcaccaacgacacccattgcacgtccagaactaattggcgacatagcattatgtaaatgtgttgcaaaacctgctcctagttgaatagccttttttgcaacttcatagcttgcattgctgtgtcctaaagaaaccaagatcccattttttacaaactcaggaatatgttttgcggttggattttctgctgctaaagtaattttagtaatgacatccgcattatcacataagaaagatttcatctcgggcgtaatttctcgaatatattcatcacgatgcacacctttacgctcaacacttagataaggtccttctaaatgcaaacctaatgcttgattttgatatttttccaaataatctcgcatgacttgcaccgcacttttcatcccttcatcaggtgaagtgataaaagtcggaagatagcttgtcgtaccggagcgtaaattcgtttcttgcataatctctaatgtgcggacactaatatcttcattaaacattacgcccccacaaccatttaactgcaaatcaataaaaccagcggttaaattattaccttttaaatcaatacgttgaatttcattacatagctgttcttcggaaacaatggctgaaattttatcgttttcaaccactactgcatgtccgtacagcacttcttttgccgtatagatcacacaatttataaaggcatatttcattttttcgtccttttaatcaagcacgctatgaatagcacgttgttccagttcagtaaaatacttaaccgtttttacttttaattcttgtgttgccggttcatcacaaacaaaaatagcatgacgatgtaattgcaatgcactaattgtccaaaaatgattaacatttccttcaacaccagcttgtaaagccaaggctttattatgtcctgttaccaacaacataacttcttccgcatctaataaagttgcaactccaatagtaagtgcatatttaggcactttagttacatcattatcaaaaaaacgagaattggcaattaatgtatcttctgttaatgtcttaattcgagtacgagaggcaagagaagatgctggctcattaaaggcaatatgcccatcaacccctacaccgcccataaataagttaatcttaccgtaagatttaattttctcttcataacggcgacattcttcatcatgatcatctgtattcccatctaaaatattaatattttgtggctgaatatcgatatgattaaagaaattattatacataaaagaatgataactttcaggatgttctttaggtagacctacatactcatccatattaaaagttacaacatatttaaaactcacttcctccgcttgatacagtttaattaactctttatatgtctgtaatggcgttcctcccgttggtaaacctagtacaaacggacgttctgcagtaggagcgaatgtattaatacggtcaacaatatattttgcagcccatttactgacttgttgtgctgtttttaatggaattaaacgcataaaatcaccttaattatttcaatattgtcatgtacaaaatgaagtgttatttcagaaatagaataataaataaaattatacactaaatctaataataattagcctatttcttaaaatagtgatctcaatcacagataaataaccgctacatttggattgttccacattgtgaaatatattattgagcaacattaatggtgtcggtataaaggataatataaaccttttgatttaccatttttccaacgcttgttgatcggattctcgatgttcaatccaacgtgtaccttggcaagtttgttcctttttccaaaaaggggctttgctttttaaataatccataatgaattcattagcctgataagcatcacctcgatgagctgtgctgacacccactaagacaatttcatcacccgtatttaacaaaccgacacgatgcacaactgcaactcgataaagttgccaacgtttttttgcctcgacaacaatttcctgcaaggctttccctgtcattgccggataatgttccaaatataaaccggaaaccgaatcgcccaaattcatctctcttactttaccgataaaaataaccgcagcacctacgctatgaggctcggttagccattgataaatcgcattttgatcaaaattttgctcttgaacggaaattttaatatctggcatttatcctcccgtaacaggtgggaaaaatgcaatttcatctccggaacgaaccgcactttccaacggtttaagcgtttgattaatcgcaaccaatagcttccctttctctaaagctaatgcccatttatcacctttttggctgagatgttgacgtaactgctctgctgttgcaaattccgctttaacctctaattcatcaacaccgattaattctctcgtttgtgcaaaaaataatacttttaacatctttataaattcacttcttgtctattcagcaataaaatgccctgattttccaccgctcttttcaagtaatctaacctgttcaataacaatgtctttttgtactgctttgcacatatcataaatggtcaatgcagcaatactggcggctgttaatgcttccatttcaacgccggtttttccacttaatttacatatactttcaacacgaacactacttatttcaggaagtgcggtcaaatttacttcaacttttgataataacaatggatgacacaatggaataagttcccaagtacgttttgccgcttgaattccggctatacgtgcagtagcaaacacatcacctttatgatgctgccctgaaaggatcatgttcaatgttgtcggcaacattcgaacgaatgcttccgctcttgcttcacgaacagtatcttgtttagcaaatacgtctaccatgttcgcttcaccttgatgattgatatgcgtaaatgttgtcatattttccttttatcctccaatactcgccaaatgatttcgaacaccgctatcgccaatatgtaaaaaatgatgttctcttttactttgcaatgctgtaaaaattcgactttttaattggttctgctgctcatcaaattgcaataaatctcgtagatcaattccttcttcaccaaataaacacaagtgtaattttccctttgccgaaactcttagacggttacaacttgtgcaaaaatttttttcataaggcatgatcaatccaatttcgcccttataatcaggatgtgcaaatacctttgccggtccatctgcacgttcttttttctgtatgctccacccttctcttataagtttttccgctaaaatttgacctgataaatggtattgatgaaaaaattgagccatttcgccggtttgcatcaattcaataaatcgcatttgaataggacgctctttgacccacattaaaaattgatcaaactccttatcattgagagatttcattaacactgaattcactttaattttttcataaccaatttcaaaagcacggtcaattcctcgcataatatcgtgaaatttatcaacgccggtaatcgcatgaaacattttaggatcgaggctatccacgctcacattgattgcactgattcccgcttttttccaatcctcaacttgtctagccattttgtagccattagtcgtcaatgcaatattttttattgtttcaatagcacgaatattttcaacaatggacaggaaatctttacgaagagtcggctcaccaccagtaatacgaactttttctgtacctaattgtgcaaaggcattcaccaatcgtttaatttcaaccagattcagaaaactgggttttgtgctttccgctcgatagccatgaggtaaacaatagttacaacgaaaattacacatatccgtgacagataagcgtaaataatagtatttacgttgaaacgcatcaataagatgattttcaataacattatgaatagaaatagatctttgcactagacacctttttaaataagaaaggataagtcgtttccaatattatccctgagcaattatatttgctggcattgtttccttatttttcaacttaggtaaacaagctcggagttatgcgataacgctcgtattttaaagaaatttaactcattagcctagtcttaaatgaatgaaattaaaaaattgtaatttagtacataaatttaagtgataaacattcaccttaagcatttcaatctttataataggtgaaattttatggagagatattatggcaacaattaaagatgtggcaaaaatggcaggagtatccacaacaacggtctcccatgtcatcaataaaacacgttttgttgcaaaagaaactgaacaacaagttttgcaagcaataaaaaacctcaactactcaccaagtgcggttgccaggagtttaaaagtcaatacaacaaaatctataggaatgattgttacaacctgtgaaactccctattttgcagaaattattcattccgtggaagagctttgttatcgacaaggttattctctatttctatgcaacacgcaaaataatccggagaaaatcaaaaaccatctcgacatgctggctaaaaaacgtgttgacggcttactcgttatgtgtgctgaatatactcaaaactctcttaatctccttgccgcattcgaagatttgccgatggttgtcatggattggggaccatttaatgaaaatacggatcttatccaagataacagtttctccggtggatatattgcgaccaaatatctgattgataatggtcataaagatattgcgattatttccggagaattaaaaaaaactaccgcagtaatgcgttatcagggatttgaaaaagcaatgcaagaagcaaatctggctatcaatcctgactggatcatggagggcttctttgaaccggaagatggctatgaatgtatgaataaaattcttgtgcaagataaactgccgactgcggtcttttgttgtaacgatgttatggcattgggtgcaatttcagcaattggagaaaaaggtttgaaagtgcctgatgatatttcagttattggttatgataatattcatgcctcacgcttcttttctccccctttaacaacgatacatcaatcaaaatcccgtttaggggtacaggcaattaacctattgtttaaacggattagtgaaaaggggaaagaacatgaaattatagaaatttatcctgagcttgttattcgcaaatcagtgaaaacgctataaaatctatcttaaaataaatctccataatatttttgtaggtatttatttttttatctattatctaattgaatatgctcaaacaatttctttaccgcattattatctcttaaacgttcagcttgctcaactaatgttcgggttaagtgcggtgagaaatattgaataaaatcgtacatataatttcttaaaaaaataccatgtttaaacgctatttgtgtcatactcgatctaaataaatggcttgcatcaagtgcaactaaatcattgtcagcctcagtatgtgccattgatgccattattcctacgcctaaccctaaacggacataggttttgataacatcggcatctgtcgctgtgaaaacaatgttaggcaataaccccgcactattaaaagcatagtctaaatcagatccccctgtaaaaccaaaggtataagtcactagaggatattgaccaagtgcttcaattgtcaatttcttacattgagccaaaggatgttccggtttgacaattactgagcgattccacatataacaaggcaataaaacaacgtcatcgaaaagatattgtgcttctgttgtaattgcaaaatcaacctcaccgaataaaagagcgtcataaatttgcgtaggagaaccttgatgaatatgtaaacttacttccggatattgtttagaaaaacgtctaatgacggaaggtaacatataacgagcctgcgtatttgttgtcgcaatacgtaaaactccacaatttggacgagtatattcattggcaattgctttaatattttgtgttttgactaataattcccttgccacggcgacaattcttgcccctgccggtgttaggcctttaatatgtttaccgttgcgttcaaaaatctctaaacccaactcatcttctaacaacctaacttgtttactgataccgggctgagaagtaaacaatgcgttagccgcatcagtaacattcatattttgattaacaatttcaacaatataacgaaattgctgaattttcatagcaatacctaaaatctcaatgagaaaaaaggtgcgtcaaaacacaccttccatgaaaaatttattgtggataacgagctgcgacttcagataatagagattgcaactctccctgttgaaacatttctagcattatatcacaaccaccaattaattctccctctacccacaattgcggaaaagtaggccaattagcataattcggtaatgccgctcgaatatccggatgttgtaaaatatcaacataaccaaaagggacattacaattaattaatacttcaaccgctcttgcagaaaatccacacgacgggaatttaggcgatcctttcatataaataagaattggattctcactgatttgttttttaattttgtctaaagtttccataatatctcttataaggtaaattcgggctgaattgtagcataatacaataaagccctaaataaatatttagggcttataaaatctactaaaggataacgatattatttgctacctttcactgagatttcaacacgacgatcttctgctaaacaggcgattaatgctttgcgacctttaaccgcatcacatttcataccagtcaccggatttgcttcaccgtaaccaaccgcactaatggcatcttgagcaacacctttagagactaaataatttgctacagtatccgcacgacgttgtgataattttaagtttgacgcatcagaaccgatacggtctgtataaccggcaacagaaacttgtgcagtttttaattgtgcgatttcaccataaacaccgtccaatgtttgttgagcttcaggttttaatgtatctttagcgaaggcaaaattcacatctgaatttaagctgaacactttgtttactacttcaggtgccataaccggtttttgaccgaaacggtaagataagccaagtgttactgcaccgatacttggtgtataatctaagcgttcaccatcattcttaagtgctttaccaacgcctttaacccattgatattccaaacgtaatgccaattccggtaaagaaggtaggctgtattcaacacccgctgcgaaaaccggagaaacttttaaagtgttttttacaccgtctgctgaattttcgaatttttcaacattaagataattagaacgaattaacgccgcacctacacgaccgtaaatatccaagccttctaatacagggtagctggcttttaagcctaattgcatcccttgagcggtatgtttagcttcgtctttacctttacgaccttttgcttgaccgaaatactcagaacccaactctacagcgacatgatcggtaatttggtaaccaccaaaaataccataagctactgaattacgaactgttcctttcttttctgcagaattttcaaattgattaagaccgtcatggaaagatgcccaaccggctttcgcaccggcatagaacgtatttgcttgaggtgccgcttgcacagaagcaacaaaacctgcgatagataacgcaataattgtttttttcatttgaatttcctctatattaattatcaagaaattaagcactacatgtattccgaagatttaaacatctctaggaattaaggtgggattttaacctaattttacaaaaaagataagttttttctctgatttatcttattaaagactaaaatttaagcaggttttccattttttttgctttaactaagaattcttttctttcatgacttgccatttgattacttgttcccggtaatttcactgttaacgggttaacaggtctaccgttaatatgaaattcgtaatgtaaatgagcaccggttgaacgtccagtatttcccgataatgctatacgttgtcctctttttaccgattgccccggtttgactaatgagcgacttaaatgcatatagactgtctgatattctttgccatgtctaatcattatataacgtccggcaccgttagcctgataagcgactttctctactactccatctgccggagcgatgatagtcgtgcctacaggtacagcaaaatcaacccctttgtgcggtcgtatttttcctgtaacgggatgacggcgagcaagattaaaaggagaagacaccctagcttgacgtaataaaggataacgtgcgaaacctttccctaaagtttctccctgacgactataatagcgtccattatttgcttggattgcgtaataactttttccaccggacataatatgtatggcttcgaccttgccttgcccagtcaatttattatctaaatactctctcgaaactaaaacggcaaacttatcccctttttttaacttattaagacttacctgccactgaagtgcggtagttaattgagcaatttgtttactgctcaagcccaaggctttcaaactggcataaaatgatccttctatctgtccttttagaacctcttctttccaaacacttttcttttctaaaatttgacgtttaaactgagattcattaactcgctcataaatacgttcttcacgttcggaaacaagccaatttaaatattccaaatttccatcattatccaatatccaataaatttgttggccagctttcaggttttttaattccggataactcgccatcatttgacgacttatttcctcatccaaccctgaatgttccaatacatctttcaatttatcgccacgaacaactgtatgtgcaaattgatctttaatacgcattgcttgatctgcagcatctaataaactatttaaggcatctttggcattatcgggcaatgatgatatttcattatccaaattaacttgatccgtttcatcatctaaaccgtctaaatcatcataagacaattcactgttatttttttcatttgcaatttgcatatcaacagatgtaggcttctgagaagaaacatcgtttctcaagaacaaccctatacccattagaataaataaaatagctacaaaaaaaacggcaacttttatgtagaatttctttttgcgtctatctctagctaatttaatgtgctgcaccattctaataacaactctataaaatttcagaacttcaataagaccgagaattgtactaaaaattcatttcatttcataaaaaaaattatacacccgcataatttatagacataaataattactacaccttgttaaaataaaaaaaataagctatttttctacttcaattttacctcagacatttgtttattatgcaaattcactctctaaaatatccattaatcgaattaaaaggcgttaatgtaacattcgcacaaaagaatattctaagcgatattaatttaacgatttatcccaattccattatgaccattgtaggaccgaatggaggcggaaaatcaacattactcaaagtactattaaaactgttgccagccacaagcggtgaagttatttatagcaaaaatgtcgtcattggttatgttccacaaaacatttatttagacaaaagtttgcctattaccgtagaaaaatttttatctttaagaaaagggacgcataaacaagatataaaagatgctttaacattactttccattggacatttacgtttgaacgctatgcaaaaactatctggcggtgaaatgcaacgtgttttgctggctagggctattttgaataagcctaatttacttgtattggatgaacctactcaaggagtagatataacaggacaagcagaactttatcaactgataaagcaaactcaacaacaactcaattgtgcaattctcatggtttcccatgatctacatcttgtcatggcagacacaaacgaagttctttgcgttaatcaacacatctgctgtgcaggctctcctgaggcagtatccaatgatccggtttttattcgtttctttggcaatcaattcgcaaaaaatatcgctttctatactcatcaccataatcataaacataatattcatggtgatatttgttgtggtcaagatttccggtctacacaatgtaaacacaaaataaattaaggaataaaaatgcttgaaattctctttcccgcttggctaaccggaatattactctcattaattaccgcacctttaggctctttcgttgtttggaggaagatggcttatttcggtgatacattggcacactctgccttacttggtgttaccttaggcatttttttacacatcaatccatatgttgctattctaatattaaccgtattattagcgatcttaatggtttggctggaaagtaatacgcaatactccatagataccttgttaggtattattgcacatagttgcttatctcttggtgtcgttaccgttgctttactgcaaaatgttcgtgtagatttgatggcttacttgtttggagatttattggcactgggatttgatgatctctattttattgccatcggagtaagcatcgtattaggaattttaatctttttttggcaacctttattatcaattaccgtcagtcctgaacttgctcaagttgaaggcattaatatcaaaagaatgcagtttctattaatgattttaaccgcacttaccattgcattaagtatgaaatttgtaggtgctttaattattacttcattactgattattccagcggcaacggcaaaacgttttgcaagaagtccggaaatgatggtgattattgctatttttgtgagtatgatttccatcacattaggattaacattatcagcattctatgatacgccttccggtccttccgttgttattagctctacgttcttatttattctttctttatttaaaaaagaaaataattaggtaaattacaataaaaagacgcaagctaaccaaaataccttacgtctttctttttattattgaaaaattaacttatttccagagagtaggatcaacgcctttacgaagtaattgagggtattgttcaattttaaattcaggatctttacccgctttgagctgttggcggtaatcttttagcaacaacataactatcggtgccaataaaacaatagacacaaggttaattaatgccataatcgccatcaccgtatctgcaaagttccatacaatatttcctgaattgactgcaccaaaatacacaaagaacaacacaattaaacggaaagtgagaataaacaatggtttattgcgaataaaacgaatgttactttctgcataagcgtagtttccgataatagaagaaaatgcaaataacaataggataaaagctaagaaatgtaagccaaattcaccaacatggtactgtaaagcatattgggttaatgaaatgtttttcagttgttcgccaccataattatctgataataaaataattaccgcagtacaagtacacacaataatagtatctacaaacacacccagcatttggatcaaaccttgacttacagggtgcttaacatctgccgatgctgctgcattcggtgccgaacccataccagcctcattggagaaaagtccccgtttaattcccattagcattgctttggaaaaaattgcaccgaacataccgccagccatcgcatcaaaattaaaggcactctgaataatacgacttattactgtcggtaccatttcaatattcatacctaaaataatcaccgcaatgattagataaaacaacgccatcataggaacaatttgtgcagaaactttaccaatgcgtttcacaccaccgaaaataattaaccccgttacgataactaaagttaccccaacatagtgcggttcccatttccaagcatttcttgtcgcttcaacaatggcattagattgaactgcattaaacgcaaatccgaacgtaaatattaaagcaattgcaaaacatactgccaaccaaggagctttcaatcctcttgtaatataataggcaggtccgccacgaaataacccgtttttatctttaactttaaataactgagccaaagaagattcagcaaatgcactggacattccaatcaacgccgttacccacatccaaaagacagcaccttccccgccaagtgctattgccgttgcaacgcctccgatattacccacacctacacggctggctaaaccagtagtaaatgcctgaaatggcgttaaagattgtccttgaactgcccgtccaaaccacatttcacgcaaactttgtggaaataaacgtaattgaataaagccggttgctaacgtaaaaaacgcacctaccccaagtaatgtaatagtcgctaaatcccatagtggtccatcaaatttatcaacaaaccaacttagtgcttgttcaatgtttattattatagttgaaaacataatctacctcccattaaattgaaacgtgagtatttaaatacaaatttaaaaaaaacaaaaacaaaaataattaaaatataaaacaaatattcttcaattagaaaaaatctaatattaaatcgtttaattaaataaaaaacaataaaaggaggttctacttttgaaaaaatactaatctcttgataaaaaaagtgcggctgcacctcgtacaccgccggaatcaccaaattttgcttttttaattaacggtactttcgctgtacgcattaaatgctgcggtaatgctttaggtaatgcttcatataaataatcaaagttggacaagcctcctcctaagataatcacatgcggatcaagtgcggtaataatattgccaattgaaatcgcacacagctcaataaaaagttcaacaaatttaaccgcactttcgtctttgtcataaaagcaccgaataatttctttagcggataacgcctttccttgtagatcacgatacaacatttcaaaaccacgaccggataagtaagtatccaaacacgctttattaccacaaccgcattcataaataggtgctttatcccaacctaacaatttcaaggcgtgataattaagttgcaaatgccccaattcgcccgccataccgctttgcccggaatggactttaccgttaaatactaaaccgccgccaaaaccggtacctagaatcaaacctaatacgacaggatattgctggttatctttatcccaagcctctgacaaggcaaagcaatttgcatcattttccgcccgcacttctctacctaaacgctcagatagatcttttaaaataggtttattgtcagcaacacgaatatttgtaatctctgcaataccggtttcctgattaacaaatccgggaacgccgatgccaactgtacctttacaggcaaatttttcatcggctttttgcactaaatgggtaatgacatttaaccattcatcatagctgtgtttgggtgtatccactctttcggaataacgtttctccaatttttcattaaatacagcaagctcaatttttgtgccaccaatatcaaatccgtaatacataaatcctccaaatataaccaataccaaccgcacttttatatcttgtcaaaaacaaaaatatcttttctttgtaaataagcaaatataatcaaatgcacaaaccaagcgattaaaatagaagccaatagatcaataggataatgcatacctaagcgtaatcgactcactaacattaacaccgcccacactgttacaacaggtactagcaatttaattttagggttgcgatgaccaagtaattgtgcaaatccaacaactaatagcagccaagttgccgcaaacattgtatgtccggaagggaaagaataacctgtttcattagcatgatgttcgatcagccaatcaggtgcggtctgttttgtctttgtttcttgataatattgatacactatttttttccgctcatggcgtttttgtgcataaaaatcatctgtactcatgtctgaattctgcactatttcttgcacaaaaggacgaggttcagaaaacattgtttttaaaccgctcttaatgccttgagtcaaaataactgaacatgccataatcacaattgcccatattgcctgttttttatcccgaattgcaacgaaataaaataaagcaaatgcaatacaagtgatgattgcataaggtgtgctacccgtttctgttaaaaaatataaaaaataatcaagcgaggcaacttcattaaattgccagtgccaatcaatgaagtaagtaaaaattggtacaacgcaaagtaataaagtatataatgaaaaacgttttaacatcttgataactcataaaatgaacttatataaggctcttgcattttaacattatcaagttataaaaagctaaaaataagtataggtattttattatgtccaaaattcagttagttgctgaagctaaattacccaccgagttcgggattttccgtattgtcggctttgagtttccagatactcaaaaagaacatgttgctcttgtaatgggcgatattaatgatgataaacctgttcttgcacgtatccattcagaatgtttaaccggcgatgctttacatagcttaaaatgtgattgcggtttccaactggcgaccgcattacgccaaatcagcgaagcaggacgaggagtattgatttatcatcgtgaagaagggcgtggtattggactaattaataaaattcgagcttacgctttgcaagatcaaggattagatacgattgaggcgaatcttgctttaggttttgctgctgatgaacgcaacttttcggtttgtgccgatatttttgcattactgggggtaaaacaagtacgtctgctcacaaataatccgaataaaattgaaaccatgaaaaaatccggtatcaatattgtggagcgagtgccattgaatgtaggtgaaaaccgctataacacagaatatctagatacgaaagcaaaaaaaatgggacactttattgtgcataataatgaaccacatttaatcacttgtccgcattgccaagaagaaattccgaaaaaataattttcataggttggcattccccaacctatatttttaactaagttgtccaataatttatttttctatttaatctttctcacttaattccggtattatgtagcagttgcacaaagaccaaaattcaatcttgaccgcaataaaatttctgatgcccttaactctcaaaatagcgttaagggcatttcttttgcttaattctaacttattttcccacacattagacaaaatttccttatcgcagacgtaaccaatcctctcaaccttgtaaaaggtaagcaactttcactaatacaaataggaatgtgattttgcgattaaaagttaagctgcaagtaattcctgttcatacttcatcatctcattgagatttttgaagtaggtttgggagatttcttcaggactgaaagcggtcataccaataagctcttgggtacggtgattaccttgccaatagcctacccattctcttaatggtaatacccataaacagcgtttaagaatattattgaacagctcaccattagacttacggcggttatctgacatataggcggcttgattagcataaagtaaggcgtatttattcgagcgatgatgatgtaccccacgggttaaatcacgctcacgggcgttaaaggattcggctaaattgttgtttacgccgcatttgctgtatgcctcttggtgattgactgaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgaagtagattagccctaaattttacaccattttcgcaaggttttaagctaccttttaagtattccaatgttaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctttatccaattattcctagaaaatccatagtaaaggtagcagaataatgtgtaatttttttagtaggttaaaacagcattttcgcaaacatccttgttgctgtgtttcattagcatttttacttctattattactttggttagcagatttacttcttgttcaaatcatcactcctttccgttgtgatatgtggaaaggcaaagagctagaagtttttttaacccccgaagaatggaggaaactatcgggcgttaatgaatcattaaaagatactgagtggatacattatccagctattgagggaaaagcagaaaaagatcctttttttataaagaataagggggtatatcagccagtaatgtattttaatggtgatagacattggctaagtgaggttaatagtaaatacccttacttaaatatatatatcccaaaaagatactagggcataatacatttatcttatacgatcaaaatttaaaaaaaagaatagtccagtataatatcataagaggctatttccgtgatcctttttttggggtatcggggagttttgattgtaataaaaatgctatgtcagatggctcagatctgatagaagattatttaaaataactagagaggtaagatatgtctaatgataatttggcgttgttggctgctgctgcgtatggcgaattctctgaaataaataatattaaggaaattcagaaaaccttaataaaaaaggctgaagtatccgctactcaagctgaaaaatttacagatacttatgaaataatcgctcatcaagcaaacacggctagtggctattcagggactattgttaaaaataaatattttacatagagagatattatgaaaaaaaagattcttgccgtatttttaagtattattacgattatatttatttctacctatccttattcattttggcttagtgaagtagttgttagaatggtgattgctgaatttgaacaaataatatttccaattaaaagaacaaaagttttgaatagcaatggttttaatataaaagaagaaatatgtatcccttataaaagtttttttggtgagtatgcaattaatattgatctaaaagataaatcgctaaaaccatttgagacaaaaagcgttttattaaatgattttgatttttatatatctatatatgatgataaaaaccaattattattttataacagccctcaagacatcagagataagtcgagagaaaaatataattctgtaacactaaatgaatatatttttcctaaatcagggtgttataaggttaatgttgaaagtgtagatgtaaataatagcaagtataaatatttatatttacgtatttttataacacatgccattccttaaattaagataaatgtaggtgattattatgaaaaaatatactttagaagttaaaatagcagaaagaggaacctcatataaaggtcatagttcttctgttgctgggcatattttctatgtattagtagatgaacatggcaacagaaaaagttttggctggggaaaaggagagaattcaacactaggtggaatagagaacattactaaaacagatgacatcgattattcagaaacaaatttcggtggctccgatgatgatatgttatacggtggcgacggggcagataccttgcttggtgaaggtggtgatgattatttagatggcggagaaggcgaagatgttgccgagttctcgggtaattttgctgactataaaatcactaaaatgggtgatggcttattaattagcgacaccaaacaaggacgagatggtacggactttttacgcaatattgagaggctgaattttaaagatattacgaactatcaagtaccagtaaccaataattttaagccacaacttccctccttccaagcctaaataactatttaatcccccctcattaaaacctaattaaacatcatttaactttttgtaaaataaactgcgagacagatcacaaatttagcatttagttgtttgctattttgaaaaattccttatactcgctaaagaggtttttataccaaaacttaggaaaatttgatgtcttttattcgtattgtattgtgggtacttttaggctggttcttactttgggctgggaaatggggttattttatatataaagcacatgagtcgtttttgcctgacgtaaatattcctcttaaattacaaaaaggctataaatacgtgtttgaatatatccctccagatgcaagtttaaaagagcaaacatggtcattagagatagagggaataagttttaataaagaatatgaaagtcatctaaaaaacttaatgttaaatgatggtattgaacatataagtaaaattaaagaggggtatctttatccagcaccagtaataaaaactagagtaaaaaatctagaaacagatgaagtatatgagaatgtattatcttttcaaaacaagaactccagccatgtatgcaatgaaaccctacaaaatatttggtgttatcattatagagctgatgtactcacaggacaacgttggctaagatttttccctaataatagatatttaatagaaattgaagttctttattctgatattagacaagcaaatttaaaatcaaaacttgttctaggtgatgcacatttaaaaaaaacatatcgtttttaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaccgaagatttctcttgcaaaacctgtctctcaacaatgcctttctcttgtaatcttcttaatgcgtgtgaaaaggcagttacaatcgaatgatgctgagatttatgctctcttttcccttcaatctcaaatgcyttaaacattatctcttttgctgacatccattggtttgggtaatgtttaaacacttttgyaatataatcgctagggtgataagcgtatattgaaatcacatttccattaccaatagatttagctttcctcttgataggacttgaaaacgggtcactctgtaatgccactaaggcttgttgtagagttacttgatgctctttcgccttttcaatacattgctcaaagtgmgwaatttgttgagyaagttcagcrattttctgccgaataaggrtttccccactcattcttgccataaataaaaatccttrtgatgtaaaataaccacaaggattttagtcaaatttagttaattggtctttgtgcaactgctacataataccgcttaattctgtgttaaaatccattttgcatttttaacccgatacaacggttacgaacaaatataggtaagataatgctccctagattaaaaaacattcctcaacttgatcctttagtttctgcctatttggaaaaattaaaaacgcaacattttgaaggtgatatcgcgacaaattatgcagaacgtttaagtttggcaaccgataacagtgtttatcaacaacttccacaagctattttatttcctaaaacaacaaacgatgtggtatgccttacaaagctagctcaacaaaaaaatttccaatctcttacctttacgccaagaggtggcggtacaggaaccaatggtcaagcaattaaccataatatcatcgttgatctttctcgttatatgacaaagatcttggaactcaatgtggagcaacggtgggttcgtgtacaagccggtgttgttaaagatcagctcaatcaatttttaaaaccctacggattgtttttttcaccggaactttctaccagtaatcgagctactattggcggaatgattaatactgatgcttccggacaaggctctctaaaatatggtaaaacttcagatcatgtactagcactaaaatctgtcttaatgaatggagaaattttagaaacaagtgcggtcaaatctgatgaatttttacaaaatattcagcatttatcatcaacaggacaaaaacttcatcaagaaatctttcaacgctgtcaacaaaaacgctcacaaattctcactgatttgcctcaattaaaccgttttttaaccggctatgatttaaaaaatgtatttaccgaagatcaaagcgaatttaatcttagtcgtattttaaccggatctgaaggttcattagcttttatttgcgaagcggttttagacttaacacctattcctcaataccgcactttaatcaacatcaaatatagctctttcgatgcagcattacgcaatgcacctttcatgctggcggttgaagcattatccgttgaaaccattgatagcaaagtactgaatctagccaaacaagatattatttggcattctgtacatgaattacttacggaagaaaaagaaaacccaattttaggtttaaatatcgttgaatatgcaggaaacgacctcaccttaattcaaaaacaagtatctcacttgtgtcaactgttagacgataaaatagctcaacaacaagataatattatcggttatcaagtttgctcagatcttccttccatcgaacgaatttatgctatgcgaaaaaaagcggtgggcttattaggcaatagcaaaggcaataaaaaacctattccttttgtggaagacagttgcgtaccgcctgaaaatctagccaactatattagtgagtttcgtcaattattagataaacatcacctagattacggtatgtttggacatgtcgatgcaggtgttctacatgtacgccccgctttagatttatgtaataaagaacaagttttgctattcaaaactatttctgatcaagtagcggatttaacaaaaaaatatggtggcttaatttggggagaacatggaaaaggaatgcgttcacaatacggtgaaaaattctttactccggaattatggcaagaattacgctacattaaatttttattcgatccgaataatcgtttaaatccgggtaaaatttgtaccgcactttattctgaacaagaactctactccattttgtcgccaatgcgggcagatcaagatcgtcaaattcccattcaaatacgagaggaattttccggtgcgatgaattgtaatggtaacggattatgctttaactttgatgttcacagtgccatgtgtccctctatgaaagttagtaaaaaccggctattttcgcccaaagggcgggcagcaataattcgtgaatggttgcgtttgatggcaaatgaaaatatctcgcctgaacagctgaattttcgtaaagtcgaagtgaaattaacagatcttgtcagaaaaattcgcaatactgttgcccaaaaacaaggggaatacgatttttctcacgaagttaaagaggctatgaatacttgtttagcctgtaaggcttgtgctacgcaatgtccaattaaaattgatgtgcccagctttcgtgccaagtttttctatttttaccataaccgctatttacgcccattgaaagattatgtggttgcaaatgtagaaatgatggcacctttaatggcaaaagcaccgaaatttttcaacttttttacaacggctaaactcactcaatctttggctgaaaatctgctagggatgactgatttaccctcattgtctgttccctctttgcaacaacagttagttgaaataaattatcaaggttattcattggagcaactggaaaatctaagtgcggtagaaaaacaaaatattttattgattgttcaagatccgtttacctctttttacgatgcaaaagtcgtcgctgattttgtagcactctgtcaaaaattaggttacaaagcaattgttctgccttttaaacctaatggtaaagcaatgcacataaagggattcctagcacgttttgccaaaactgcaaaaaatcaagcggacttcctcaataagataagtaaactcggtttatctctggtcggtgttgatcctgccattgttctttcttatcgtgatgaatataaagaaattctcggtgatgaaagaggagattttaatgttatcactgctcatgagtggttgaaacaagaattaagttcagggaaacttgagcataaacttacacaaattatgcaaaaaaataaccgcacttttaataaagaaagtcaacaaaaatggtatttatttccacattgtacggaaagtactacactaccgaacagtgcaaaagaatggcagcaaattttttcagcttttggacaagaattacacaccaaaaatgttggttgttgcggtatggcgggaacgtttgggcatgaaattcaacacctagagatgtcaaaagaaatttaccatttatcttgggctaaaaaattacaaggaaaaaatcctgattattgtttagctacggggtattcttgtcgcagtcaagttaaacgtatgctccattggcaacctaagcatcctattcaagccctattatcaattatttaaatagaaagaacttgttatgaaaatttggaaaaaaaactacacattagaccagcttaaccaattaaccgccaattgtgccgttgcacatttaggtatagaattcactgctcaaggtgatgattggcttgaagcaactctccccatagatcatagaacaactcaacctatgggatatttacacggcggtatatcctgtgcattagccgaaacagtagggtcagcggcaggtttttgttgtgttgatgaaaatcaagcggtacttggtgcagaaatcaatgcaagccatttacgccctgctacaagaggaaaagttacggcgagagcaacaccaattcggataggaaaaaatattcacgtttggcaaatcaatctttacgatgaagaacggaaaatttgttgtagctcaagactaacattaagtgtgatagcaattaattaacaattaaataacgttgctcgttggctattaacaccaatccacaacgcatgatttaccattgacatcacaagataataatttaggaagttatatagtgaaaaaagacaataaaatactcggcgtagtgctaggcatagggcttattttagtggggatatttatattaaacagtcccttattgactttattgacaattatttcgtaccttgcatgggcagttttgctcagggggttattttccctctttaaatgttataaatcacataaaaatacccaaccatttgataaaacagaattagccgctggcatcgtcttaatgattcttggcgtgatattcttaaccaacccttcatttaccaatgcacttgtattttatttagtcgccttttggtttatatttgaggggattgtcggtatatattatgccgccaaacaaaaagatgcagcaaaatgggtaggcattgtgctggggatttttctcgtattttttggcttatccatttcagtagaacctctcagagctatattggcactcaatctattgctgggattggcagtagtaaccaacgggattcaactcctaatcgttcaactgatgaaagagaaatagagggctaccgaatgaaaaaaatcggtattattcttgccaatttaggtacacccgatgaacccactcctaaagcattatctcgctatttatggcaatttttgactgatccacgtgtagtggatctacctaaatggcgttggtatccgttacttaaaagcattattttgcctcgccgatcagctcgggtcgccaaaatatatcaaaccgtttggacagataaaggttctcctttacttgtcatttccaatcaacaaaagcaagcgttacaatcccacttcgatgaacaccggattaatgcaacagtagaaattgcaatgacgtatggtaacccgtcaatggaaagtgcggttgaaaaactattgaaaaagcacgtgaatgaaatcatcttgttaccccttttcccacaatatagcagtacaactaccggtgctgtctttgatgcttttgcacaggcattaaaaaaacaacgcaacattgtgccttttcagtttattcattcataccatttacatgaagattatatcgaggcactggtaaatagtattaacactaaacacaaaccggatgaatacttaattttttcttttcatggcataccgttacgctatgaaaatgaaggagattattatcgtaaacattgtcatgaaacagttttagctgtagtagaacgtttaggcttgcgtgaaaatcagtggcaaatgacgttccaatcaagattcggaaaagaagaatggttgcaaccttatacggataaagtgttggaaaatatttatcaacgaaatatacaaaaagttgccgtggtttgtcccggattttccgcagattgtttagaaacaatcgaagaaattaatgaagaaaatcgaagaatttttctctctcatgggggagcgtcttttcaatatattcccgcacttaatgcagaaatgcaacatattgaaatgatgtataaattaatctcaagtagattataaaatcaactggtaaaatagagctgtaaaatactctatttacatctaaaaacattaatcttaaaatgccccgtcatcgcataccactgtcagttaaatttgctgatttatctttctaactctcaacgaattaaaggaaattgagatgaaaaaattaactaaaatgactttagctaatctgattttactcggagcaattcaaacagcgaatgccagtgataatactgtgtatctttatacatggagtgaatatgtccctgaaggattattagaaaactttactaaggaaacaggcattaaagttattgcatccagtttagaatccaatgaaacaatgtatgccaagctaaaaacgttggggaaaaacagtggatatgatgttattgcaccgaccagctattttgtgtctaaaatggcaagagaaggtatgttaaaggaattagatcacagtaaacttcctgtaatacaggaacttgatcctaatatgttagatagaccttttgacaaaggtaataaatactctcttccacaactattcggtgcaaccggtatcggatacaatacggacagtcaaaatccggaacaactgcaatcttggggtgatttatggaaccctgaatttgcaaataaactgcaaatgctggatgacccaagagaactatttaatattgcattactaaaaatgggggaaaatccaaatacccaagatccaaaggtaatagaaaaagcctatcaagaattattaaagctacgtcctaatattttagtttttaactctgataatcccgcaaatacctttattaccggtgaaacagatgtcggcttgatttggaacggatctattcgtgtcgcacaaaatgcaggcgtaccgattaaaattgtttatccaaaagaaggaaccatgttgtggattgataatttagccattccagcaacagctaaaaatgttgaatcggcatacaaactcatcaattacctgttaagtgcggatgtttccgaaaaattaacgctcgaaataggctatcctacttcaaatctcaacgctctcgaacgcttgccaaaagaattaaccgaaaataaaggtatcttcttaccgcaagaagtgcttgatcgaagtcaatggcaagtagatgtaggagaggcggctgaactttatgaaacttattatcaaaaattaaaaaatatgcaataaatacttccccgaaaagaactcatgaataatccccgtaaactgcggggattttatttatcagataaactatttttaaatatttttactcaccaacttaaatgaagtttaattcgctttatattcttcaatcacaacaggtaaagtcaaggttttatctaaacgctgtatgaccatatttattgtggtattaggtttagtattactaatcgcttccatcatttgagcaggagaaacagcatcaataccatcaaaactaacaatcacatcgccaggctgaataccggctttatgtgcagggctaccttgtaatattgatgtaattaaaattcctttatctcttaaaccctttccattgctaaatagaatatcactttgcacccctaagtaaccacgaataactcgaccatcacgaatgattttttgcataacatcattagctaattcaataggaatggcaaaatttaatccttccgcaatttcgttggcattcttaccaatacttaacgtacttataccaatcaattcaccagcagaattaatgagtgccccaccggaattaccacgattaagaggggcatccgtttgaataaaattttgtcgtccaatgaaatcgccaacagcattacgacccaatgcactaataataccttgcgacacactttgacctaggttatagggattcccaatagataaaacgacatcaccgacatgagcttgacgttttggattttgtggaatggttgccagattatctgcatgaatttttaaaaccgctaaatctgtcaagcgatccgaccccactaacttcgcttcaaaaatacgtccattttgtaatgccaccacaatttgatccgcattttgaacaacatgctcattagtcaatatataaccatcttttgacataataacgccggaacccaagttattaatttgtggctggtagttattggttgtaaatgcaaaagcttgattataaacattaactaccgccggtgaagcaatacgtacagcatctttataagaaagaatatctttttgtataaaaaaaacatttgtcaaatacccatttcccttgaaaacaggcaatataagtaacaccaatgctgcggcagctaacccagtgattattgattgaattaatttttttatcattatgtgattgccctcagtatcataaaatgtgacgctgataattcaacttaatgtcttcgccaatttgtgccaaagataacaattgccactttggtgcatcggctaaacggttcaaatgtggtaagtgacaaaagccacgagctttattacccagtaatttcggtgccatataaataatgagctcattcactaaattttcctcaataaatgcaccggctaaagtttctcccgcttctaaccaaagactattaatctgacgctttgccaattcaatcaacaagttttccaaataagaatgctcgttacttgggaataattttatatattgacaataatcaggaaacgctgacatatcacgctctttatcacccaccagccaaacgggagattgacattgaaataatttatgacgaggagtcacaagatgctgacgatcaagaataattctgacaggttgacgcacttcttcaactttataattttgttgtaattccgatggaaattgctcccaacgaagatttaacaagggatcatcggctaacaccgtcttagctgtcgataaaattgcagaaactttagcccgctcttgctgtacgtcttgccgtgcctgttctccgctaatccatttactctcgccattagccatagcagttcgaccgtcaaggcttattgccattttcaaaataacaaaaggtttctgtgttctcattcgtgttaaaaaacctttgtttaataattccgctttttcttgtaataatcctaccgcactttcaatacctgctgcttgcaacatagctaaccctttgcctgcaacttgcggattaggatctttcattgccacaataacgttgcgaatacctgcttcaattagtccttttgcacaaggaggcgttcttccgaaatgagaacaaggctctaaagtcacataagcagttgccccctttgctctatcaccggcatcacgtaatgccataacttccgcatggggttgccccgctttaaaatgaaaacctctcccaacaatttcaccatttttgactaaaacacagcccacagcaggattaggtgttgtggtaaatatgccttttttcgcaagatctaaagctatctgcataaaatattcgtcttgagctgaaaatgttggttgcatcactaatcctttaatttttcaatttcattggtaaattgattaatatcatcaaaactcaaataaaccgaggcaaaacgaatataagcaactttatccaattctttcaattcagccatcactaaacgcccaacatcttgacttttcacatcacgctcacctgttgctcgtaattgataaataatgcgactaattgctttctctacatcatcagaactcacaggtcgtttttctaaagcatgttgaatgcctcgacgcaatttatcttcatcaaaaggttcacgtgagccatcatttttgataattttaggcacaataacttccgcactttcaaaagtcgtgaaccgctcatgacaatatccacattccctacggcgacgaacctgataaccatcagaaaccaagcgactatcaatcacctttgtctcctccattgcacaaaaaggacatcgcataaaaaatccttaattaatcaaaaaaaaataaagcttatcttagcaaaatagacgtaacttgacgatatatttacatatcagtcaacaacgaaatgagagttcccttttagatttagaataaattttgacattcattttcttttaagcgtttaatgaaaaacatgttgtaccaaaaccatatacaaaacggtaccgactgcaatggataaaaacatgtttttttgccaaaaatgcagtactaatactacaataccagcaatgaaatcaggtataccacgatgacctgtcgtcagatcaatatttttatagcaatatactaccaacataccgaacattgctgccggtaatactttgcctaaatagcgaatatattccggtacagggcgattagctggaaaaatccagaaaggcaaccagcgaaaaagctgtacacctaaaattcccataccaatagtgattaactgttcatgaaaagtcacttatctctccctatctatccaatttagtcgccagtttttgcgataatattgaacggcgtaatgttaaatacaaccaaatgccaatcagtgttggaataagaaaaccctctttccctaccgttaataaagaaatcaatgcgattccgaagccaaataatgaactttcatgagatttttcttttaaccaattttcagcaaaaataactaaaaataaggctgtcattgcaaattcaacaccggcgagatcaaaaggcaaaatagaaccgaatagcgtacctaaagcagcaccaatgatccaatagcaatgtaaatataaactgacaaaaaagaaaaaccagcctctatctatattatgaggaatttttgccatatagtttaaagaaaaagcttcgtcaactaatgtggcaatcaaataccaccgttttttacccaaatctccgctgtatttctccagcattgagatggcataaaaaatctgccgcccactgaccattaatgtgattaataaaacgtgccaaggagaaaaagtactaactaatgctcctgcaataataaattctaccgaaccggcataaattaaggttgccattaaaataggataccaagttgcaaatccttgcactttcatatataccccataggctatacctaaaaacatgaatccggcaagaataggaaaagaatgaggcaaggctacttttgccgcattccatacggtttttgattgattaagatctgacatacaataactattctaaaatagacaatccgggcaaggtagaaaaacgttgagatttaataatctcatagaaatcatcaataaaggcaacatcattatccgtttctcggaaagcaccatagagatcactatataacccttcatcagtaatttttcttgccacaacatagcctctatccaaataaggttttactgcccaaaacggcaatgtcgccacaccacgtttacttgctacaagttgaataatagcaatggttaattcacttgtacgtcgagaaggattgatgcctttaggatgtaaaactttacgtagaagatcgagcatatcatcaggcacagggtaagttatcaaggtttgctcaacaaaatcttccgcttgccaaacctctttccccgccaaaggatgatcctttgcacacaaaccaaccatttcataggaaaacaagggcttatgaataatacccggcgtttcttcaatttctgatactaccgcccaatcggctcgatgactcagcaataaaccaatagcatctgtatggaatccagacacaatatcaagttcaactaaaggccaatgttgacgaaaattatccatggcaggcatcagccaatcaaaacaagtatgacattctacagctatttttaactcgcccgcctctccttgtttaattctcgataaagctcgttcagtctccatgaccttaggcaaaatttcattggctaatttgatcaaccgctctcctgccgctgtaaaccgcaaaggatgacttttccgctcaaataaaggtaattgatattgttcttccaataatttaatttgatgcgaaagtgccgattgagttaaataaactctctttgcagccaaagaaacactccctgtttcttttaacgcaatgagcgtttttaaatgacgcaattcaagaaaaataggtttcatgaagattttgataacaaaaaacaatttgccgtattgtacagcaaaataaaaggatcaaaaaggctttctcctctttgacccttagtcaactacatcaaggtaaaaccgatctttaccctatccacactaagtgcggttagttattgacaaatttttcgcctaattcaatatcagctcgtaaagttggcaacatatcttctaaggctttttgttcaaatgcacttaaggtacccaccggtaaaatttcctccaccccttcttttcctaagcgaacaggttgtgcaaagaaacgagcatatttaccatcaccttcaacatacgtacattccacaacagtttcaccacttagcccctgtaccagtgagagagcaaaacgtgctgctgcttgagccattgaaagtgtagcagaaccgccacccgctttcgcttcaacaacctcagtaccggcattttgaatacgttttgttaatggtgctatttcgtcctctttccattcggtatattgtacttgggataacaatggaagaatcgtcacaccggaatgtccgccaattaccggtaccgcaatgcgtgaaacattgagtcctttcaattcagcaacaaaagtttcagaacgtaatacatctaatgttgttaccccaaataatttacgtttatcataaacgcctgcttttttcagcacttcagcagcaattgctactgttgtattaaccggattggtaataatacccacacaggctttaggacaagttttagcgactttttcaattaaatttttcacaatacctgcattaatattaaataaatctgaacgatccattcccggtttacgagcaacaccggcagaaattagtacaacatcagcgttttctaaagcgggagttggatcttcccctgcaaaaccttgtatcttcaccgctgttggaatatggcttacatcagccgcaacacccggtgtaacaggtgcaatatcatataatgataattctgaacccgcaggtaattgtagttttaataacagagccaatgcctgaccaatacccccagccgcacctaaaacagctattttcataagaacctccttatactcatacagttacaaattgaaccgcacaaattttaaaatgatcaagttcttatttcaaacaaagaaattaaattgtgcgatctacctcaaatttttaacaaaaattatttttaaatgttgaaaactaagaatataaatataaaaattatctacctattttgcatttttatgcagcattccccaacgtcgatttaagagagaatacataatgatcaatgaaaaagcagatagcctagtcaacgcttttaaagagctactttcccaagaaagctttggttcccaaagcgaaattgttagtgctttacaacaaatgggatttactcatgtcaaccaatcaaaagtctccagaatgttaacaaaatttggagcagtgagaacacgaaatactcgtatggaaatggtatattgtcttcctaatgaattgagtgtacctaataccggtagcccattaaaaaatctcgtgttagatgtagatcataacgaaacattaattgttatcaaaaccagtcccggtgcggcacaactcatcgcaagattactggattcggttggcaaatctgaggggattttaggcacaattgcaggagatgatactattttcgttacccccaccacaggaaatgatattcaggttttaattactaatatccaaaaattattcgaaagttctttataggattgtgatgaggaacataagatgaaaatattcatcacaggtgccaccggattgattggctcaaacttaatccctctcttactggaaaaagaatatcaaattaccgctttagttagggacatggagaaagctcgtcatcagctacctaatcaagttcagttggtcaaagcactgtctcattatgagaatttcaatgattttgatggcgttatcaaccttgccggagccccgatttttgcccaatattggacaaccggctataaaaccgaactcattaatagtcgccttaatttaacggaaaatttaaccgcacttattaataacagtaacaaacctccacattgtttcatttccgcttccgcaacaggttattatggcgatcaaggaaataatctcattactgaaaaatctctgagcggaaatcaatttactgctcaattgtgtcaacaatgggaaaatattgctttacaagccaacagcagagtgtgtttattacgcactggaatggtgttttccgaaaaaggcggtgcattaacaaaaattctaccaatttatcgttatggacttggaggaaaactcggtaccggcaaacaattctgggcatggattagcttacaagatatgctacaagctattctgttcttgctggaaaatgcacaatgcgaaggtgcgtttaatctcgttgcaccaaaatctattcaaaataaagatttcaattgccaattaggtacatggctaaaacgtccttatttcacaacagttcctaaatttttacttaatttattgttaggtgaacgagcgacccttttattagacagtcaaaatgttattccacaaaaattattggaagccagatttcattttagcacaccgacattcagcgattttttacattcgataaagaaataggatatgttatttacaaaaaaaacaccgcacttaataagtgcggtgrkttttkctttgggtgtagcaagttagctaaattaccactgatamcccacrccaaccgaaccgccgacatcgccsgttgaactgcgagtaccttgyaatcgtagcgttattttaccgttatcactyactcgtgaataacctaacgcyaccgcactttgtcctttataggaacctgccgaagcagcaaacatggatttacccggcacagaagacatcggcaaacctgaagttgccaaagcmcccgcaatcccygctcgcaattctttattggacatatccagtttattgttgagattgctgagtttttggtcggyttgtctttgyaamgtatcyacatatttyttattcaccaccgcacttycaytsgtygwtgsytkaatatcmggyacggtaataataccgttttcaccrtcaatcttaatttcaccgtttgctccggttacggttaagccgtttttattaagaacarctttyggcatttttggattttgctgattttgtgctgaggtgttgtcggcaaaggtcaggctttcagcagttattgttgctttattgccagttttcttatcttccaacatgatattgtccgcaccataagttgccgatttgtckttgttgctaccatttttgttgttgacaacagttaagccatcgctatttaacgtcgattttttaccgcyctcctctttggtttcaaaggctttcatatttttcaasgtatccgacagttttatttctaaaccatctttggctgtattggcttctaccttratrttrccagcggcactactaaatgaacttgtagtttgaccgttttgagtttcctcttcccctttaatagttaaggtatcgctgatttttctgactacatcatcgccctgatttcctttaaatctcaacccagcttgtgcaaccgcttttaartcagcgagattrgcggcttgatgcagatcttgttgctcagtcatttkttgcccttgctggctacttatgccgttggaaaccagttttttcactagatcaagggatttaccttgtttttcagattcagrcttacctttcatactatcattatcaattcccaaggcggattttagatttttgatggcaacagggtcatgagccttacctccattttgaggtttaccgcctaaagtgattgattttttatsttcatcatcatatttcaccgtcactttatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatatcttcagtcgcttcaatcttaaaggaaatggtgcctgtattcgcatcaatactcggtttgatatagtcatcaccttttaatttaattgtcgcaccaagttgacgtgtcattttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgcttgtgccgtgttggaattatccgcttcaatttttagcgttaatgaatccaattgagttttcaagtaatttttaaccgcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtaccgccaacatttttaagtttttcggtcatatagtttcttaccgccgtttccgttacgagtttgttgcttnnnnnnnnnnnnnnnnnnnnnnnnnnnnnnnnnnnnnnnnnnnnnntgtcggttgactccgcttcaaaggaaatttccccttttgaactatcaaggcttgctttgagatgttgtccagttttgaaagttaccgttgcacccaattgacgggtcatttcgcttgaagttccagcagaaccgcccgcacttgtgccgttttcgactttgaatttcaagccctcgttgattttctcaatgtttttggtaatagcgtctttaaatgttgttaaagctggatttgtctcagctccgtttttatctttcaacttagtaaacgtagtttgtttaaaaccggctttgttagtttcggctttttctgcacctaatacgtcggttcctaaatagccgaatacatcgataacgccttttaattgcccaccgttgatcgcatctgtggaaccgtccctaatttcacccgcagcaacatgtctaataactctttcacttcccatatcccctatacttagcacggattttttatcagaatcggatgcagatgttccagcattttcccatttaaataataggctataactgccattaacacttaactcttgtgttttaaatgcttgtttcttatcttctgccttagaacctttacctaaagcaatcgaatcccctgcattagtggatacagtcgcaccctcaccaatcgctaccgctccggcagcacttgcttgaacagttgcatctttaccaatcaccaccgcactttcagcttgagaaattgcatgtttaccgataatcactgaatttttggcgtttgttattgtgccattacttccaccgttctcaccatttcctattatgattaaatttgcattttcggaacctatattaagattacttcctattgcaactacattactaccggaacctgttagtgttattttattacccagtgctataccccatgcggaactttctatttttgtttctcctgatacaccaattgcgattgaagcatcactactttccaatacttttgctttataccccaatgctaaagattgttctgatttaacttgagtttccgcacctagggcagttgaccatttggcatttgtaactaatgaactacgaccaatagcgatggcatcgtgtgaattaccattttctacttttgcactcacaccaatcgcaatggaattttgggcttttgctccgtcgttatcaaaattgtcgtttctgctacttgttgtggcggaagcgrcggtgccatttcttaccgaaatataatgcaatttcgcttctgtaaattgtttgaagtttacggcatcgttatcttgtgaaccttcagcaacatttgaaattttgactttatgatttccattacttcctgtttgtgtaaaagttaatgcagtaccgccaacttttaaagttgcagttgatgtactatttgacccattactaaatgatagaatgttattattgtcttttcctacgctgttaataccttttaaggtatcgctaagtgctattgttaaatcacttccagaagacgtagtggtaatatttttatggctgccatttgaactatcttcttttcctttaatatttaaagtgtctcctaattttagagattgttctccgccagtatttccagcaaatttaagtcctttgtttatcgctgtgatggtatcttcaattgcttctctaaaagtagacttcctagcattagttccatttccattatatgagacagctgtaaaagtagtctttttaaaaccatctgttccagtatccgctttctccgcaccaagtacatttatccctaaattagcaaatacatcaattacgctataaagttgcccgccattgatagcatcggttgaacctgattgcactgttccggcggcaacattcgttattattcgttccttaccgctgtccccaatacttaaaacagacttgtcccctcctgctccggcattattccaagaaattgttatatcattagctcctgtagtagatataagaccggttggtgcggtctttgtcatcttcgcctttgagttcttacccaacgcaatagaatcgcctgctgcggtggatacagacgcactttccccaatcgccaccgcacctgtggcgttggcttgaacattcgcacctttaccgagtaccaccgcactttgtgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatattattccccaacgccacgatatctgtaccgctgttgattttgtttttattcccaagggctaatgaccattcggcattatctaattttgtatggtcagaaccatttccttcattaaccgcactgatagcgattgagccttttgcattgttgaatgtaacgccgttaccaacagcgacaacggcatcttgtttttctttactgctttgtgtaaccgtaatacctgagcctaacaacacggaatgttttacatcaacatccaagtccttaccaatcacaatcgcttgttcagcttttgatttcgcttcgtacccaagggcgatggcatatttttcggtcgcttccgcacccacaccgatagcgatcgcacctattttcgttgcaccatcgttgttgtagttgccttttgtgccactcgaactgctagaaccgctacctgcaccgtttgtaccatcattcaccgacaaataatgcaaagattgcgtaccagtactgcttccgccacttccgccaccgcttgtaattttgctatttacatagtctataactgcttttacagtcgttaattttttgtcatcgccgttgctgttaccgcctgatgtgctgttaattgaatcagttgcattgacttcaaacttaatttggtccttaccactactaccttcagtgcttaaagtcagatagtcgtcgcctttaaaggtcaatgattgtccgagttgtcttttgatagtattgttgttactgctaccacttccatttcccccaactttaaaggtcattccttggtttatggctgtaatagtgtcttcaatcgcttctctaaacgtggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacttgtgcacctaatactttggatcctaattctccaaaaaattcaattaccctaaataactgtccgccattgattgcatcagttgaactacgtcctacatttcctgcagcgacatgttttatcagactttcgcttgaaccacttcctacattaataacttgtttattagaaccagtaccagcatttttccattttaatattatagaatctaaaccaacattaatgtctgtaccatcaagtgcggtttccatagtccctttcgaaaataaatcacttaaccccgtggctttggtgattttttggtttatgtcgtcgttgagtttgattttgatggggctacttgaacaattgtgtattacttgagagtttgaactcccaaatccccctcctactccattgctttgtttactacaagtaaatgatcctacatctacatcgataaaaccttctccctttatccccgttttcatcatattttcgacatctttcgcttcaccatcttgtaatcctgaaacaccgggtgaaaaaccttgtcccaaaacctccaccggcaacaccaccgacaacgctaacgccagcggtgcgagtttaaacgccccgaaaacaccgaaaaacacaccgcacttcggcttactctccgaactgctctctatttggcgattacttgccaactcggaaacggctttacattgacctgttgtaatatcatatttggttttgaagattttgttcatattctttactcactgtttgtttattcatctgtttttttgggtttttgttgtgtttttatatttatagagcagttataaacctaagcggaaaattgctttgctttttaaggcatagcaaaaaaagacgaatgatattttcgccgaggggttgaaaagggaaaatggggatatttttaaaggttaataatataaaaaataggttgcagggcttgcaacaaggcgttagcctagactgtagactgtagactgtagactgtagactgtagactgtagactgtagactgtagactgtagactgtagactgtagactgtagactgtagactgtagactgtagactgtcatttttcctgttctattttatttgtcaagtaaaaattcttgctatcctatcctaaatttttatagaaagaaatgatttttttactttttatcctaacttgattgaggcgaacaattaaaatgtttgatattcaaagaggattaaatcatcaccgcactttttagcataacgaaaaatcctagctccctatggggtaagatttcacatttatatggcacgatcagataaaattgaacgcttaaaagtgcggtacattttacagagatttcatttttctgttgttcttacgctgagaaatagcgataatgtgcgatctagaaaatccattgaaaacttatgatagattatattttactgattattagtaccgcactgattaataactttgttctagttaaattcttaggactttgtccgtttatgggcgtttcaaaaaaaattgaaaccgctattggcatgggattagcaacaatgtttgtacttactgttgcctcgttgtgtgcttatttagtcgagcgttatttactcactccactccatgcaaatttcttacgcaccttgatttttattcttgttatcgctgttgtcgtacaatttactgaaatggtcattcataaaacgagcccaacactttatcgtttactgggtatttttctccctttgattaccactaattgtgcagttcttggcgttgcactgcttaatataaacttagctcataacttaactcaatccgtcatttatggattttctgcgtcgcttggtttttctcttgttctagttttatttgcgggattgcgtgaacgtcttgcagcagcagatattccccttccctttcggggagcctctattgcgttaattaccgctggattgatgtcacttgcttttatgggctttaccggtttagtgagagtgtaaataatggcaacattacattacgttctgccggttgttgttttgcttgccgttctttttggggtaatcttaggctttgcctccattaaattaaaagttgaaggcgatcctatcgtagaaaaaattgatgcgttgttaccacaaagtcaatgtgcacaatgcggttatcccggttgcaaaccttatgctcaagctattgcgaatggagatgaaatcactaagtgtgtacctggtgggcaaccattagtcatcaaaatagcagatttattaggcatagaagcacctagcggtaattttgaaaaagatcctgtacccaaaatggcattcattgacgaagatatgtgtattggttgtacaaaatgtattcaagcctgccctgttgatgccatcattggtacaaataaagcgatgcacaccattattgccgatctttgtaccggttgtgaactttgtgttgcaccttgcccaacagattgtatttcaatgatcaacgtcaaacaacatattgataactgggattggaagttcgatcctaagttagttattcccatcgttgatactacttcagcacaaaagaaaatcgttgtaggagaatagggaatgacacagcgtatagatatattaaccaattacaattcaggtaaactttgggatttttatggaggtattcatccgccggagatgaaatctcagtcgaaccaaaccccgataaaaaacttgcctttagctaacaccttttatgttccggtcaagcaacatgccggaagtgcgggtaatattttggttaaggtaggagatagagtcttaaaaggtcaagccttaacgcttggctcaggtttaaacgcattgcctgttcatgcccccacatcaggtattatcaaaaatattgccccttatgttgccgctcatccttcaggtctatgcgaattaagtattgaaattgaatccgatggattggaacaatggcgaaaacgccactcaatagaggactttttaacacttagccgagaacaactcattgataaaatttatcaagcaggtatcgcaggattgggcggtgcggtttttccaaccgccgccaaaattcgatcagcaaacaataaagttaaactattaattattaatggtgcagaatgtgagccttatatcacttgtgatgatcgcttaatgcgtgattacagtgaagaaattattgagggtatacgtattctccgttatattttacgtcctgaaaaagtggtaattgctgttgaagataataaaccggaggctatcgctgctttacagcaaagtttacatggtgctgatgatattgatattcgtgttattccaactaaatatccttccggtgcagcaaagcaacttatccaaattctaactggcgttgaagtggcaagcggacaacgctcttccagtattggtattttaatgcacaatgtaggaacagcatttgccataaaacgtgccattattgatgatgaacctttaattgaacgagtggttaccttaaccggagataaaattgcacaaaaagggaatttttgggttcctttgggaacgccaatttctcatgttctaaaacaagtcgcttatcaatatgactcacgcttccctgtttttatgggcggtccgatgatgggctttatcttacccaatttgtatgctcccgtaactaaagcgactaactgcttgctggcaccggatcattttgaatatgaaccgccggcaacggaacaatcttgtattcgttgctctgcttgctccgatgcctgccctgtacatttaatgcctcaacaactgtattggtttgccagagcggaggatcataaaaagtccgaagaatacgccctaaaagattgtattgaatgtggtttatgtgcctatgtttgtccgagtcatattcctctcattcaatatttccgccaagaaaaagcaaaaatttgggaaattaaagaaaaggcacaaaaatcagaagaagccaaaattcgttttgaggctcgtcaagctcgcttagaaaaagaagaacaagaacgcagagcaagggttaataaagcggcagaaaatcgtcgtgcggaaatggcacaacaaaaaggaattgatccagttcaagccgcacttgaacgcttaaaagcgaagaaatcaatcgaaacacgtgaacacaaccaagaacagaaaacgtttataaatattaaaggcgaaatattgcctgataacagcgacatcatagagcaacgtaaagcacgtcgtttggctcgtcagcaaaccaattcaaacagcattcaagaaattgaaactgttgtacaaaattcggagaaaaatacagaaaaaagtgcggtacaatctggcgtagatccgaaaaaagccgctgttgctgctgctattgctcgtgctaaagcaaaaaaacaggcttcacaaattactgcaaatagtattttggagcctgatactacaatacaaaatacagaaaaaagtgcggtrcaatctgrcrtagatccgaaaaaagccgctgttgctgctgctattgctcgtgctaaagcaaaaaaacaggcttcacaaattactgcaaatagtattttggagcctgatactacaatacaaaatacagaaaaaagtgcggtgcaatctgacatagatccgaaaaaagccgctgttgccgctgctattgctcgtgctaaagcaaagcaattagcaaaaaaacaaattgaagttaccaataaatgaaacaaagagattttacatgtttaaaatgattagctccccacatactcattcggggaaattgacagcccgcataatgttatgggtgattgtggcaatgttaccggcaatcgcagggcaagtatattacttcggatttggcgttttaatccaatcactgttggcaataagtacggcgttatccctcgagtttgttgtaaccttattgcgtaaaaaaccaaaatttttttatattggtgattttagcgttgttttgaccgcacttattctcgcagttgccattccgccttatgccccctattgggttattattatcggtacatgttgtgctgtaattttaggtaaacatgtttacggcggattaggacaaaatttatttaatccagcaatggttggctatgtcattttgcttatttcatttcccctacaaatgacaacttggttacctccaattcaactgcttaacgaaccacctcattttgccgatgcgtataaactcattttccaaggtgttaccactgacggttttaatttaagccaattaatattggctattgacggtatgagccaagcaacgccattagacacagttaaaacagcaatgcgaaataatttatcttcattacacgaagtcagctcatcacctattttcagttcggttctaccattgggcaaaagggatattgttgaaggaatgggctggacacaaataaatttactcttttttctagggggtatcttcctaatttggaaaaaaattattcattggcaaattccaaccgcacttttagcaactatttttagttttgcattgttgaactggctattttcctcagctacaccaaacccaatttggcatttagtcagcggtgcaacaatgtttggggcattctttattgctaccgatccggttaccgcttcaattacaccgagaggaaaactcattttcggtgcattagtcggattattaatctgcttaattcgtttttggggaaattatcctgatggcgttgcttttgctattttactggcgaatatttgcgtgccactaattgatcattacactcgtccacgtgttataggtcataacaaaaaaggaatcaaacaatgagcgttgcacaaataagtagaaaatatggcatattgttgggaacagtcgcctttatttgtaccgcactttccggtgcggtatattggctcacgaaggataaaattgcttttacgatagctcaacaagagcggtctcttttagctgaggtaatgcctaaagattattatgacaatgatctgttagccgactgcaaaatgctctcatcttctttggcaaaagaatatcgtattaataaactttgtacagcaaaaaaaaatcagcaaattagtgcttacgcttatgaaactatcgcaccggacggctactccggcaatataaaaatgttggtcgcaattacacgacaaggcgaagtgctgggcgttcgaattacggaacatcaagaaacccccggtctaggcgataaaattgaattacgaatttccgattgggtactgaattttgcccataaaatgttacagccgaacaatttaaacgattgggcagtcaaaaaagacggcggtaaattcgatcaatttaccggtgccacaattacgcctcgtgctgttgtaaatcaagttaaaacttcagggataatacttctaacacaacttgataaacttgctgtggagaatgaagaatgagtacaaaaaatctacccgaaacacaccgcactttagatgaatttgaaccctctcatttgactgtaaacaaggttaaaaccgaaagtgtatgggtaaatttatttaaacaaggattttggcataacaaccctgccctagttcagctattaggactctgccctttacttgcggtatcaaattcagcgataaatgctttaggtttaggcattgcaactattatcgttttaatttgtagcaatactgtagtttctttgtttcgcaaacaaatccctcaagagatccgtatccccatttatgtgatgattattgcgactacggtaacgatagtgcaacttatcatgaatgcttatacttacaccctttatcaagcattaggtatttttattccattgattgtgaccaattgcattgtaattgggcgtgcggaagcgtttgcctcaaaaaataccgttttacattccatttttgatgggtttgctatgggacttggcatgaccttcagtttgtttattttaggtgcattacgtgaaattttcggtacggggaaattattttttggtatagaaaatttatttggcgactgggcaaaatgtttacaactgaacctatttcaattagacaatagtttcttactggcaatcttaccgcccggagcgtttatcggtctaggcattatgttagcaataaaaaacgtgatagatcacagaaaatgaataaacaaaaacgtatcgaaatattaactcgtctgcgtgatcaaaatccgcaccccacgactgaattgcattttaatacaccttttgaattacttattgcagtcattctctctgcacaagcaacagataaaggagtaaataaagcaacagataaactttttcctttagctaataccccacaagccattttagatcttggtttggatgagttaaaaaaatatataaaaacgattgggttatacaatagtaaagctgaaaatattattaaaacttgccgtgatttaattgaaaagcacaatggtcaagttccggaaaatcgagaagcattggaagcactggcaggcgtaggcagaaaaacggctaatgttgttcttaatacagcttttggtcatcctactattgccgttgacacacatattttccgagtgtctaatcgtacaggatttgctcccggaaaagatgtcgtaaaagtagaagaaaaattattgaaagttgtaccatcagagtttaaagtggatgtacaccactggttaattttacatggtcgctatacttgcattgcaagaaaaccgagatgtggctcttgtattattgaagacttatgtgaatttaaagaaaaaacagagatttaacataaattataaatagaaacgaaggtataacattatgacaaacaccccaaaaagacaaacttggtccagtcgattaacctatgtcatgacagtagccggagcaaccgttggatttggtgcaacttggcgatttccttatttagtaggtgaaaatggcggcggtgcttatgtactgctcttttgtattgccatgttagttatcggcattccaatgattttagtggaaaatgtcatcggtcgtcgcttacgtgttaattcaattgatgcattcagtgataaattagaaggaaaaaatatttctaaagcgtggaaaattattggctatatgggattactcggtgcatttggtattatggcgtactatatggtacttggtggttgggtaatgaattatatcatcaatctcattaccggttccctagatatttcatcggtaattaacaaagaatatgcccaaaatttttatcaagagagtattactgaaagtccgctacaaatcataatttatacactgatttttgtcgtcattaactatattattcttgctaaaggaattattggcggcattgagcaagcggtaaaatatttgatgcccttattgtttatttgccttatcggtatggttattcgtaacgttactttaccgggagcaatggaaggaattatttattacctcaaacctgatttttctaaaatcacgccacaattgtttatcctcgtacttggacaagttttctttgcactaagtttgggatttggtgtaattatcacactttccagttacctcagcaaagaagaaaatctcatccaaaccgccgttataaccggatttacaaatacaattatagctgtcctgtcaggctttatgattttcccgtcattatttacttttgggattgaaccgaatgcaggaccaaccttagttttccaaagtttacccattgttttctcacacttatgggcagggcgtatttttgctgttgtcttctttagcttactgctcatcgcagccctaacaacctcaatcaccatttatgaagtaattattaccgcactacaagaaaaacttagaatgcgtcgtgcaaaagcaatttttatcacgttaggcacaattttcttaatcggtaatattccatcaatattaagtgataatttgttaaaagacgtcacattctttggtaaaagtatcttcgatacgtttgattacgtcagcggtaatattttatttttattgaccgcacttgggtgtgctatttttgtaggctttgtactaaaagaagatgcgataaaagaactctccccaaatccaaattctttatcgactcagatttggttcaattatgtaaaatttgctgtaccattaattattatcgtgatttttgtaagtaattttgtttaatctaaaactgtttaatttatagaggacactatgcaccatatatttatctcagataaaaataatgatatccgtcgtcatcatattgaaaatgaaactaaaaaattagggattacccctaatttttatgatgcaattatggcacgtgatttatcaaaagaagaattatcaacgcttactatccctaatacatttttaaccccaggagaaatttgttgtgcaaaaagtcatctagaggggggggggtaaaacgattgttagaaagcaatcaagaatacatttttatttttgaagatgatattctcttttctgataactttacgcctgaagtcattaacgaaattacaaactttatatcctctttgcaaaatccatctattctagttttatttaacagcatttataaaaagaaaaaagtaaaagatcttaatagtgctatatctattttttctgctcacaatttattctatgcttgtggctatgtcattaacagacaagcagcagaaaatattctaaacatccaaacgccaatcaagtttgaaattgatgcttttaagttttattactggttagatgcctgcgatttatattgtctaaatactgacttagtaaaacccgctccagaaatttcaaacttatcagagatagattgcgacaaccctagaaaatatacaaagcaacgcacaattaagaaaaataacgcatatcgtcttttatacaatcaactgagttggcaaaataaattaaaagcaaatataaagagaatacaaaaaatgttacataaaccctttgaaaaattgtagtttgtaatacattctaaatgggtagctttgtaggcaaaaatcaataatctaactttttaggttagattatttctgttatttactcctttaagatacctaaattccaattttctgctgacgttggacgtttttcttgcaataagaaacgttgatttgcctttgcttgaggttgtattactttactggatggtgtagagaaagaaataccgcctttaagcaattgctgcatggttcccgtattaatggacaatccgctcaagccaatttccacaccgtacccggaagaaatccaaaactctgtattttggcgaacaaagtgttggtatttcttagcaattaataaatgaactaaaactcgatcacctaattgatttagttccagtttagatatagtacctacctctataccacgatacatcacaggggatccgatactgatgtttgtggcatcagtggcttctagaataattggaaagccgttgccgtatttgtttgccggaggtacggacgaaagcaatttaaagtttgttttttttgcaccttgtccaatttctacgtcaatataaggttgtaataaactatcaatattatcaatgccaccggctgaaatgtgcggtgaaatgaggcgaaatttactgttttctttcgcaatgatattcatgtattttgcatgaattaatgcagtagccttgattttatgatcttcggttagattaatttgctctatttctcctataggaagccccatatagcgtagtgccatacctttagtcaagtttgttgcatcatcagcgataaacgtaataacttgttctgccgatttggctttcatttcatttgcataaagggttctattgcttcctgagcctgaattatcaaaactgaccgcacctttcaaagaacgggcgataggggttgcctgaatactaattccctttggcgttatatcaatttgtgccgcactttctacccaaaaaagacttttggttgtgagtaaatgtttatatttggggtaaataaaaacatcaacttcaaaatgattagcggttggtctaatatctaaaatcttaccaacttcatattgacgataaagtacaagcgagcttttatttatacttggtagattttttgtagttaacgtgatattaggctctaaaatattatcggtaataccgaattctgcactggttaaatccttatacaaaggatattcttgttgtgcttgtccttcctttttaccgcttgatataaccctaattcccccttgcaaccattttttcggactagcagcttccattcttaagccatcaatacccaaactaatatcaaagttactcgctgcaataaataatgtatttttatgaataagttgacgatatttttccgctattgctacttggaaaataacgcgttccggtgtactggtaatgttgacaatttcaccaatattttggtgattatagtaaagtgattgcccttctgtaataccgtaggtttcgggtgaaatgaggtttattactagggtattgggttgtttgagtaaaagctcgttttctttaatgacatgaaaagtcgtttgtgcttctcccataccggcaataacatcaatgtattttcctcgcaaaaaatttttcacatcggttaaatcgccgagcgaaagtttttgatcacgtaaaacaagaattgagcctgttttaaacaaatatttcatattcggatcaactaataatttcccgtgtaaaattttttcgctattttctatcgcacttaattcagataacacgccaatttgtatatcttgcgaatagattttagtgtgtccagcatctaatcctgctacattaggaacaataacgttgatttccgtacctcttttagcagcttgaatattttcatataacgtatagtgtgcattattttcagctctaggactttctcttggagaatcaaatgcaacagccccctgtactattgcgtttaagctatctgcttgaatattgatacctgataagcctaaatttgcgttgattccggtaatgttccaaaaatgactgtctttttttacaaagtgagaataggctttgttgatgataacatcaacttcaacttttttctgatctttcgtgagccgataatcggcaatttgtcccacaggaatttttttaaagtaaaccgaggctccgctggataaagaacccagatcatctgccagtaaatgaattaacaaatcaccatcattaacttgtgttaatggagcttcggtttccgcaataaacgtattttccggcttaccatcgccgggttgtaatgtgatataattacctgaaactaaagcatcaattccggagattcccgccaaagaagcactaggctgcactaaccaaaattttgtattttccttgaggatgctttttgcctccggataaatatttgctaatacttccacttttttgagatcatcagtgaaatttactttttttactacgccaatttgtaacccttgatagcgaatttgtgtttttccggcaactaaaccggctccattcacaaaagttatcttaatactttccccttgctctttaataatctgaaagaacaaaagtgtacagatacataatgcaataaagggcagtaaccaaaaaggcgatatacgtttggtttgtttaatttgggctttcaattcttccattgtttctatttgattatctaattttttgtttgtcataaatattccaaagtaaacgactatcaaattgtgaagtcgacatcattgttaaaaataccgttgctccgaaataaaatgcggcaggacctactgaaaaatcaataagttgccctcttgttactaatgacatcatcagagcaagtacaaataagtcaagcatggaccaacgtcctacgaaatgtacaaaatggagcaagcgtatttgcaggtgaatcgaatgttgccatttaaaatgaatggagaacaaaagataacacataattaaaatcttactgaaaggaataaaaatactggcaacaaatacaacaaatgctacaaagtagcttcctaaattgataaaggtcagaacgccggacattaatgtgtcttctgttgctataccgttcacataaactatcgacattggaagcaaattagcaggaataatcattacgaccgcagccaataaggttgcccaagttcgctgtaaatagacttcatctgaaaaatcaaggcgtgatagacaacgtgggcaaatggggcgtcgttttctatccgtatgacaatgattgaaagtatgttcacaatacttgcacgcaataataggaagatttttttgttgtagcggagttttttggggataaaaatgccgccacaattcagcaggattgatttttataaataataatttggtcaaaagtgcggtaaaaataaatgcaattaaatagctattaatatgtaggcttgcatattcttgtactttgaacatggttacgcccaaagcaactaaataaacatcaaacatcacccagggttttagataatttaacgttaacagtaagtgacgaggtctgatgtctaatagctgtgataaacgaagtaaaataactaataaagcaaagcttataggcataaataccgcacatagaaaaatcataaatgcagtgtaaggatagccttgaattgccattttccatataccttgccaaacagacgcatttactggcgtaccaagcaggttgatggttaataatgggtatcctaaggcaaacggcattaaaatcaaaatagtcaatgcgatgattgcacaacgtttcaaatcccaactggaggtgttttgcagtactttgtgacaacgaggacaattcgctgattgatttttttgtaataagccaacagaaactaacgcattacaatcagtgcaacttataaggcagtatttagcttgtgataaattagtttttttctgcatgttgtcttattgatgaataataaagaaaggctattctaacctaatttttatcggaaatactatttttcattatagtcataagagaaaagtgcggtcatttttagtgaaagtttcgtttcatttaagtattaattgtttatttttttttgttttaagctaaaatgtggcgagtttttttatctaaaaagtcattaagacaggaatatataacatgactgaaattcaaaaattaacaaataacaaagaaattattgcttacttagcagaaaagttcccattatgtttttcattggaaggtgaagcgaaaccattgaaaattggtttatttcaggatttggctgaagcgttagcaaacgatgaaaaagtgagtaaaactcaattacgccaagccttgcgtcaatatacttctaactggcgttatttacatggttgtcgtgccggtgcggtacgtgtggatttaaatggtgaacctgccggtattttagaacaagagcatgttgagcatgccgcagctaagttagcagaagctaaagcgaaagttgctgaaagacgtgcggttgaaaaagcaaataatccaaaagcaaataaaaaacgctctgtacatcgttcagcgaataagtcagaaaataagaaatcagctggaaagaaattctccaaaccccgtcaagttgaacaaatttttgtcaacgttgatttagcaaatttacaaaaaggagatgtggtgagagttaaagcgggagataaaactactaaggctgagatattagaagtggttaaagagggtgcccgtgttgaattagagaatggattgatattaactgtaaatgcggatcgtttatttgcgtaattttataatacatggctaatttagtacctcatctcctctggtattattttcgtgtttaattattttaggaaagtgatctatgaaattacctcaacaacttcgttatttgctttgtttgctgtttggctttgttttaagtttaaattacgccgtcgcagttgaaccaaaactgaaactaacggatcttgttattccacagataacgcaagaaaatcaattagcaactaaaagaactgctgctcgtttggttcattcacattatcaagcagtagaactcaatgatgagttttctcagcggatttttgatcgttatttgaaagcacttgattttaatcgtaatacttttttgcaatctgatattgataatatgagagcaacgtatgcggataaaattgatgatgtgttaaatgagggaaacctggatattgcctttaatatgtatgagttattgatgaagcgtcgctatgagcgttatcgttatgctctatctttattggatgaagagcctgatttaaatggcaatgatcaaattgaaatagatcgggaaaaagcggattggccaaaaaatgaaactgaggcaaataagttatgggaacatcgagtcaaaaatgatgtgattaacttaaagttaaaaggtaaaaaatggcctgaaattcaaacgaggttagttaaacgttataatttagctattcagcatctaagtaaagtaaagtctgatgatattgtacaattgtatttgaatgcttttgcaagagagattgatccccataccagttatctggcacctcgcacagctaaaaatttcaatgaaaacatgaacttgtctcttgagggaataggtgcaactttacagtcagaagatggtgaaaccactataaaatcgcttgttcccggtgctccggcagatcgtagtaaaaagcttaaagccggtgataaaattattggagtcgggcaagcgacaggggaaattgaagatgtagtcggttggcgtattgatgatgttgttgataaaatcaaggggaagaaaggaacaaaagttcgtttagaaatagaaccagctaaaggtggaaaatctcaaattattacgttagtgcgagatcgtgttcgtttagaagatcaggctgctaaactaacagttgaaactgttgctggtaacaagatcgccgtgattaaaattccggggttttataatggcttaaccgaggatgtacgtaaattacttgctgaagttgaagctaaaaaagcggaagctttaatcattgatttacgtggaaatggtggcggttctttaccggaagctattgagttaaccggtttatttattactgacggtcctgtggttcaagtgcgggacgcacatcaacgtattcgtatatatgatgatcctgatacagaacaagtttattccggtcccttgcttattatgattgaccgatttagtgcatccgcatcggagattttttcagctgcgatgcaagattataatcgagccattattcttgggcaaaatacttttggcaaaggaacggttcagcaaagtagatcactgaactttgtatatgattcaaatagtatggctcctttgggtttactgcaatatactattcaaaagttttatagaattaacggtggcagtactcaattaaaaggagtcgctccggatattatttttccctcctctattgatgatgaagaatatggggaagaaaaagaagataatgcgttaccttgggataaaattccatcagcgtcatattctgaagtcggtaatgcacgcctgccggtagatatattgaatcagaaacatcttgaacgtattgcgaaagaccctgagtttattgcactggatgaagatttaaagattcgtgatgaaagaaaagaacgtaagtttttatcgttgaactttgctcaaagaaaagctgaaaatgataaagatgatgaaaaacgcttgaaagatcttaatgctcgtttcaaacgagaagggaaaaaaccactaaaagatcttgatgctttgccgaaagattatgaggatcctgatttttatttaaaagaagctcagaagattgcggtagatttaattgaatttaataaaaaaatggctgagtaaaataagatttaaaatatccgcacttttgaaaagtgcggtcttttttgttatctaaggaactaaaatgagaaaaattaaagttatcttattaatcttattattaggcactacgactcatatttatgcacaacaaaagtttaattctatagatgagattaataatattactttaagtaaatcacaattattgtttgaattagatttattggaacaacaactatccgaggaatatcagcatagattatatgaacaattacattctttgctcagaaatatagatttacaatttaaaactacaattggtcgtatttatgttgaaaatgactatgcattgctttgggaagataagcaagctgaaaaaatgtttttacgtgaatatgctgcaatggttgcaagcggagtctctgaaagagcggcaagattattgaatgatatttataaagcatctgaaataggagggttagtttatgatatgttgctgaccgacgcatttttggattatatgtattattcaaaaaatgcaaaaaattttgcacaacagtggttctactcagcaaatagctacaaagctcaattaccatcaaaacaagatattcaacgatggctatcatcaataaaacataatgaaaatttgatgttcatcgaacaattagctcaacataatgagcaatatgagaaaattataactcacctgagtaaattaatacctcaagatgacaagtcaatattatacaaattagcaattaatgctcagcgtttaaggattattcctgattttaacaatggtatttttgttaatattccaagttatcaattaaattattatagagatggagaattagttttaaactctaaagtcattgtcggtaaaaaagcacgtaaaacaccggtaatgtatagtaagctaagtaatattgttgttaatccaccttggatacctactcctcgtttaattaatgaagatatcgtgccaaagattaaacttgatccggattatgttgctcgtaatagttataccataagtgatagcaaggggcaggttatagatccttcttcaatagattggaatactataggcactaattttccctatcgaatccgccaagctccgggaggaagtgcattaggaaactataaatttaatatgcccagttcagatgcaatttatttacacgatacacccaatagaggattatttagcaaaaaaaatagagcattaagttcaggttgtgttcgtgtagaaaagtcagatcaactggcgacaattttattaacagaagccggttggacagaagaacgtaagcaaaacgtgcttaatagtaaaaaaaatacttcggagaatattcgctccgataatcctgtatatttatattatgttactacttgggttgaaaacgatgtcgtgaaaacattacctgatatttatgagtatgatcaagtacctcatttaacttatattaactggaatattattaaatggtatctaaattaaaatgtgagcagcaagaactaaatattatgtttgctgtcgaaagcaaatcatttagcactttataacgaaatattatatgaatgaaattaatcaaaatcgtcgcaaatggctatctttaggagggattattcttggtgcagccttgttacctcaaagtgttttagccgtattaccgaagccttctaaatctaaatttttatcttttagaaacatcaataccggagagagatttcgtggtgagttttttgccaataaaggtttttccagctctgatttgaaaaaaatagatcatttaatgcgagataaacgcaataatcaaattcataaaatggatcccaagttatttcataaatttgttcatattcaaaacaacttaggtttgcaaaattctgaaattcaaattatttgcgggtatcgttctccggcgagtaattccgccatgctacgtagtggtcgaggtgtcgcacgtaacagctatcatactcgtggacaagcaattgattttcgcattgagggggtttcattagcgaaacttcgtcaaacagcagaaaatttgaaaaatggcggtgttggttactatcctcgcagcaattttattcatgtggatacggggccagttcgtacttggcgaggtagctaaaatactaaacgtaatatagttgaccgcactttattcaaagtgcggttttattatttaaataaataaggaaatgatatgaatattgaaattgtgccggtaacggcatttcagcaaaattgttcaatcatttgggataataacaaaaatgcggctattattgatcccggtggtgaagcgacaaaattaattaaacgcattgaagaattaggcttaaatcttgaattgatcttactgacccatggacatattgatcatgtcgaagccgcactgaagttaaaacaatattttaatgtagaaatttggggttctaatgaaaaagatgattttttatttaatagcttaccacaacaatctgagcaatttggcttactttttgagactgaggtatttaaacctgatagatggttaaatcaggagtatgaaattgtccgtattggggaaatgaattttgaagtattgcatcttccggggcatacccccggtcatgtcggttttatcgaatatagtaaaaaaattgcttttaccggagatgttttgttccaaaatagtatcggaagaacagactttccaagaggaaatcatgctgaattaattcaatctattcgtgacaagttatggaagttagatgatgatatgattattattgcaggacatggtaattatacaaccataggaaaagagaaaaaatacaatccctatatccgctaaaagttaagatgcaaattatgttattgatttacacttaaaggacaattcactagaatagtcaacatttattaatttatcttgaattctataaaggtagcaaaatgattgatccaactttattacgcaataatctttctgaaattgcggaaaaattaaaagtaagacgaggctttattctcgacgtagataaattttcacaattagaagaacaacgtaaggctttacaaattaaaacggaaaatttacaagccgaacgtaactctcgctcaaaaacaattggtgcggcaaaagccagaggagaagatatttctactttattggcagaagttgatcatatgggagccgaattaaatactgtcaaagaagaattagcgaatgtattaacggaaattgagcaattggcattaacaattcccaatattcctgctgatgaagtacctttaggaaaagatgattctgataataaagaagtttttcgttggggaacaccaaaaaaatttgatttcgaagtgaaagatcatgttgccttaggggaaatattaggtgggctagattttgctgctggtgttaaattaagtggtgctcgttttgccgtaataaaagggcaaattgcaagaatgcatcgagccttggcacagtttatgctagatttacatactgagcaacatggctatacagaggcttatgtaccttatttagtcaatcatacaacactttatggaacggggcagttaccaaaatttggtgaggagttatttcatataaaacccctagaaaatgaacagacttatgcgttaatccctaccgccgaagtgcctgtaacaaacttagttcgagatgaaatcatcgatgaagtcgatttaccaataaaaatgaccgcacatacgccttgtttccgttctgaagcaggttcttacggtcgtgatactcgaggtttaatccgtatgcatcaatttgataaggttgaattagtacaaattgttgaaccggaaaaatcaatggaagcactggaagaattgacaaatcaggcagaaaaagtattacaacttttaaatttaccttatcgtaaagttttattgtgtacaggcgacatgggattcggagctactaaaacatatgatttggaagtgtggattccggcacaaaatacgtatcgtgagatttcttcttgctcaaatatgtgggatttccaagcacgtcgtatgcaagcccgttgtcgtgcaaaaggcgataaaaaaacacgcttagtacatactttaaatggatcgggactagctgttggccgcactttagttgccattcttgaaaattatcaaaatgcagatggctctattaccgtaccggaagtgttacgctcttatatgaatggaatagaaattattggtaaataatctgttgccgaaagataacaacgctccttttgggagcgttatctcatcaagccaaacctgtcataatcttactctcaaagaaatcataatctactaaaaaagcatcgtgtccataatctgaaggaaattcataataatttaaatcaacgccgctttgctccaataatgctttacttttatgtagatcggtcaatttaaacagctgatcagtggtaactgcgaccaaagtatagcgtgcttttatacgacttaatgcagccttaatgtccttatagttccaagccggatcatataaatctaaagcccgcaataaatgcacatagctattggcatcaaaacgttccaaaaattttttcccttgataagttaaataagattcaacttggaaataatctccccaatacagactttccgcttttttagctcgtccaaacgctttttctaattgaaaatcggtacgataggtcagcatacccaacattctcgcaatagataaccctttacttggaggcagtctgtcataataatctccattattaaaatgaggatcattaataatcgcttgacgcatcacatgattaaacccgattgcctccgcacttaaataaagtgacgaacaaagattaaccactctgctaacgcaatcaggataatcaatagcccattgtgtcgcttgcattcccccgaacgagccaccaatcacagcataaagttttgctatatccaatgtattcagcagttctcgctgaactttcaccatatcttgtacaataatatgcggaaactgactaccgtaaggtttatttgtatcaggattaatggacgacggacctgttgtccctttacagccgcccaatacattagaacaaataaaaaaatatttactcgtatcaagtgccaatccctcgcccataaaactctgccaccaaccattttgcgatttatcagcaaaataaggttcagcatcgccggtcaaagcatgacaaattaaaatgacattgctcttatctttatttaaagtaccataagtctgataagcaacttcaatattttttaattgcccacctcgtactaacatcaagggataatcggtaaaaagcgttaaagtttgtacagccatgtaaatttctcaaaaatcttaataaaaagcaccgcactttataaaagtaacccctgtaaactactcatactctgtttcattgtcaaggaatttttagccatctaaacatctagacagccaataaaatttacttgaaattacccgcttttttcattattttgtagcctccgaacgaggcagctataaaatgaacttagatttcacacaactttcttttccacaatggataataacactcgtcaagcgattactacattacagctttgctttcagcatttttacatttttttcccttattatcattgatcgcagcatagcttggtatgttcaggacagaatttatacaaaaattgaagaacttccctcccgcccttatggtattgtattaggcacagcgaaatactttagtaaaaataatcccaatctctactacaacaatcgcctgactgctactgttgagctttttaaacaagagaaaattgattatttattattgagtggtgataacagaacaatgcaatacaatgaacccataaccatgtttaaagatttgcgaaaaatggatattccagaagatgttatgtatatggattttgccggttttagaacgttagattccgtcattcgtgcagataaagtctttaaagcacagcccatgacaattattacccaacaatttcactgcgaacgagctttatttatcgcaaaattctatgatatcgatgctatctgctttgccgcaaaatcacctgctaactacttatctgtacgaatgagagaattatttgcaagagtaaaagcgattttagatattgtattagaaaaagagccttattttttgggaaatccagaaccgctcccgacgccaataactcaattatgatcttcgctaaataatctagcaagcttataaaaaagacaataaagttaaaaatcccatcagacaacatattattttccaaccattttctaccgcacttttggcaaaacatttattaatcacgatcaggtaaaaattttaaggttttacacagacttatatttgtcaagattgaaaaaagaaaaaaaacagaaaaattttaaaaaaaacttctagacttaatgtaaccatttgaaaaataatgaaatgttattttacaaccaattttatatgaagatatggaaaccctagattttacaaggtttaagcgaaataaatcttgaataatttacagagttatccacaggttatgtggatagtaatttgcatgaaaaaatttttactataataaaaaaatcctgttgacaagcatacaccagatcattatcatacgcacctctccttatgagaccatatttatggtatttttcctccttagttcagtcggtagaacggcggactgttaatccgtatgtcgctggttcaagtccagcaggaggagccagttttttcttttgggttgtttttatttgtctccttttataaaaactcaatttaccaaaagactttaagcccatttagatcttctccttgtatgggcttttattttttcttttctatattcaaatttctcgaaatttattttatactcgctactttcacacttcatttatatctcgtttaggttcaaatatgttattccctatactcgctattatttcaggtttaattattttagtttggagtgctgatcgttttattgacggtgctgcatcgctggctcgtttcctcggtatgtccgcattattgatcggcattatcattgttggttttggaacatctgcccctgaaatgatcgtttctgccctttccgctttaaatggaaatcccggacttgctttaggtaatgcttatggttcaaatattggtaatattgccctaattttaggtttaaccgctttaatcaaacctgttatagttaattcgctggttttaaaacaagaattacccattttaactttcgtcactttagtttctgcttacttaatttatgatgctgaaatttctcatttagatgcgattattttacttattatttttgctatatacatggcttggagtatttggcaaagcaaaagatcagcccaagacagttttgccgaagatgtaacgacagaattggaagaaaaaaaaaccatatcagtaaaattagcagtattttggatgattacgggattgattttactaatgggaagctcacaattattggtgtggggagcggttcaaattgcttctcaattaggtgtgagtgatttagtgatcggtcttactattgtagcgattggcacttcattacctgagttagcagcctcaatcatggcggctcgtaaaggtgaagtagatcttgcggttggtaatattattggttctaatttatttaataccttagctgtcgttggcatagctggcttaatttccccaattcaagtgagcaatgaaatatttactcgagatatgttagttatggggggattaacgctctcactgttctttttcggctatggatctcgtcaaaaaaatggctcgattaatcgtgttgaaggcggtttattgataacaagttatatcgtctatacttatttcctcattaccaccgcactttaaacaataaattaattgggagattaatttctcccaattaacaaagctcccccacgtatcggtaaagttgtgccatacattaaactcaaggcaaaaaatataatcatcagaccagcaagtatcctgactaggatatgccaaaacttcttatgtgttgaaaaataaaaatgccctaactgaaccgcacttttccgtgcatacaacacaattaatgcaaaacctgacagcattaatccaacacctaatgacatcgctacagtagccaacattccccaaacatacaaatccaacatatacgacaaaaataggataaatattgctccagaacaaggacgcattccaatagtgaaaataaccaaacattgtgattttaaactctgtgcttgctgtaactgttgctgattaggtaaatgctgatgcccacaagaacaattatccgtatgctcatgaaatcttgacaaattttgtaccgcactttgcatacctattttattggtaggtattgaagagagcgtgaattgcttgatttttagcgactgactattttttttcaaaaaagacttgctcccttgccaaatccattgcaatcccaaaataatcatcaagaaataagctccacgttctaaccaaagctgacttaatttaaaatagctcgaggataactgtaagatagccacaacaattaatgtcagggaaatcgccacaataccttgcattaaagaagcaaaaaaagttaatttcatactggtttttatctgggattgatgggttgccagataactaccaataataaactttccatgccccggacctaacgcatggagaacaccataaataaaactcaccacaattaatcccattcctgcataaacaggggcttgttttacttgatgcaggtaacttgaaagtaattgattaaattctctctgccaaattaaaacgtgtgaaaataaatatgggaacagataaataccacctaacgataaaaatacaagtaataatataagtttataggttctttttattgacattggataactactttttgtgcaaatataacgcctaacgagctgtcttcatcacgttggttacgatctaaagaggcagcatattctcgtaatttttgatcaacttgaggttcgacaacatttccttgacaatgttgcggaagtgacgaaaaatctaccgcacttttctccttgtctttatcgtaatacatagatacatagtaggttgaatcataagtagataattcaaaacggttattggataactcctgaggtttagctaataaaaaatcaaaaaaatataaaacttgtgcaccgttagattttaatccatagttttgaggaattgcagaatacttaattttatttcctttcttatcatacaaataactaaaataatgttcattaacaacattttggatcatatcatcaataaatttttgtaattctttttgatcatcttgcaaaaaagccaaatcatataaaaccgcagatgaacttgattcatctaaaatccattgcatagaaaaaccaactaatttttgcttgtcaataatgggttttgtctgcatttcaataaaagcgtgtgggtgagctaaactgtatataggcaaaaaaccaagaataatcccgaataaacgaatgaattgttgcatattcttccaatcaaataactaagtacgcattatgctatcacaatatagcgttgatttttatcttttcaaaaaaatcatgagaagttgagtttgcggaaattaagccccctaaagaacagagttttacggcaccgtcagataaaaaacttacggattatcacacataaagctaacaaaaatcagtaaaagtgcggtacaattcgcaagtttttcacttttcaaacgtggcttatgaactatcaaacatacattcctgatgaatatactatgtgtcaatttggtaaaaagttgatacatagtattgctcaaatcaaaagtaacaaaggaataaccctttatttacaaggtgatttaggagcaggaaaaactacgttaagtcggggaatgatccaaggtatagggcataccggtaatgttaaaagccctacttataccttagttgaagaatatcatcttggtgaaaaagatatttatcatttcgatctttaccgccttagcgatcctgaagaattggaatttatgggcattcgagattactttaatgaaagatccatttgcttaatcgaatgggcagaaaaagggcaaggcatattacctgagcctgatttaatcgttcatatcaattactttgatgatgcacgtagtattgaattacactctatatcagaacaaggccatttaattattcaacaattagtttaaaccatgaattacttacaacgcttgattttcattattttagcgattttcgcctttaatcatgcttttgctcacgtttggacaattgccatcgatcccggacatgggggaaaagaccccggtgctattggacgtcgtctcaatatctatgaaaaaaatgttaccctttccattgctcgtgaactaaagaaattgttagataaagatcctcactttcgtgccgtactcacacgagaaggcgattattatatttcagtctctaaacgctcggaaatcgcacgtaaacataaggcaaattatctcatctccattcatgccgattcatctgaatcaagtttgttacgtggtgcatcggtttgggttttatccaatcgccgagccaatagcgaaatgggacaatggctggaagatcatgaaaaacgttccgaattgttaggcggtgctggtgatgtcttagcttcacataaagaaaaatatctggataaaactgtattggatctgcaatttggacatagccagcgtgttagttatgaacttggttcagttgttttacgtcactttgctcgtatcgcaaaattaagtcgtagcacaccgcaacatgccagtttaggcgttttacgttcccctgatattccgtctattttggttgaagcaggttttctttccaatgcagaagaagaaaaaaaattaaatacccttgcctaccgtaaaaaattggcaaaagttatttatgatagtttagtagaatatcgcaaacgcaatttaaaagtagacctcaataccacaaagaatacccgccaaactaaaccaaagaccaacagtgcggtagataatacaaataaaacacccgttaaagacagcggtattcgtcataaagtaaaagcaggcgaaggattaacgagattagcaagaatctataaagtgaatattaaagatattatcagtttaaataaactcaatcgtaatcaactttggcttggtgaaataataaaaattcctgctaacaatgaaaatacaccaaaagagaaagmgaaagcgaaagagaaaaagaaagctaaagataaaaatgcaacattccatatagtgaaaaaaaatcaaacactctatgcaatttcacgtcaatacaacattcctgtgaaaactttgctcaaactcaatcccaaactaaaagatggcaaagtacaaacagggcaaaaaattaaattacgtgaataagggctaagcaaacgtatgacaattaaaattcttcctccacaactggctaaccaaatagcggcgggcgaagtggtagagcgtccggcttctgtcgtcaaagaactgattgaaaacagcttggatgcaggagcgacacacattcaaattgagattgaaaatggtggtgcaaatttaattcgtattcgtgacaacggcataggaattgcaaaagatgaactccatttagctcttgctcgccacgcaacaagcaagatcgccagccttgatgatcttgaaatgattttaagtttaggctttcgtggcgaagcactcgcaagtatcagttcagtttcccgtttaaccttaacctctcgtacagcacaacaaaatgaagcatggcaggtttatgcacaaggtcgagatatggaaaccagcatcacacccgcttctcatccgattggcacaacagttgaagtagcaaatttgttttttaatacgcctgccagacgcaaatttttacgtacagacaaaactgaatttgcacatattgatgaagtaatccgccgtatagcgttggcaaaacctcaagttgcttttacgttgacccataacaataaattaatacaccgctataaaagtgcggtaacaaatgagcaaaaaattaagcgcattgcgactatttgtggcaatgattttatgcaaaatgcgttacatattgattggaaacataatgatctacatctttccggctgggttatacaacctcagtttgctcgtcatcaaaatgacctcaattattgttatatcaatggcagaatggtgaaagataaagtgattactcatgctattcgtcaagcttattcagaatatctgagcaatgaaaaatatccggcatttgtattgtttattgatctcaatccgaatgaagtagatgtaaacgtacacccaaccaagcatgaagttcgctttcatcaagctcgtctaattcacgattttatttatcaaggcatgacaaatgcactcacctctgaacaaaccaatattccaatacagagtgaacaatccaatccaaccaaagttgccgaacctcaaggtatttggaacttgaccacgcataacaaaggtaatcgagcgactgccggcaaaaatatttttgcccagcaacctaaagattatgataaaaaatcatctcaatttaaaccgcactttgcagcaaattacagcgaagtaacgccaaagaaagcagtgcaaaaagcctatgcagaattactcgcaacacatgaagaaaaaactatcgcctcttctactctaccccatcaatttacacacaatacaacgcatatcagcgaacagaaaaatgttttacatgcacttgcattaattgaaaataaggcattgttattgcaacaaaaccaacaatatttcctcctttctattcaggcattgcagcatttcaatatccgcttacagttgcaacaaagtaatattgcacaacaaacattgcttattccgattttattgcgtttaaataaacaacaatatcaatcttggcaacagcaagctctattttttcaacaaagcggtttcgattttacagaaaattctgcacaacacagaataactctaaaccgtttacctatttgcttgcgtacacaaaatatacaaaaaataattttacagttattggatcaacctcatgaaaaatacactatttttcttaccgcactttgctcacacttggaatttccctcgctcagtactttctccgaagctgtaaatttactcacaaaaactgagcaacaattttcaacccaacatcaaccggaattccaatctttattagtcaaaatagactgggatcactatttagataaattgcaatgaataaaaaatcaactgctatctttttaatggggccaaccgcttccggcaaaaccgacctcgctatccaattacatcaagagcttcctgttgaagtcatcagtgtcgattcagctttaatttataaaggcatggacattggtacagcaaaacccaatgcacaagaattagcactaacacctcatcgtctaattgatattaaagatccaagtgaaaattattctgctgcagaatttcgtcatgacgcattacaagaaatgaaaaaaatcacgcaacaaggaaaaattccacttcttgttggcggtacaatgttgtattacaaagccttattggaaggactttcgccgcttccttcagcggatgaaaaagtgcggttggaaatagaacaaaaagcagaaaaatttggttgggcaacactacacaacgaattagccaaaatcgacccaatatcagcacaacgtataaatcccaacgacagccagcgaattaatcgtgcattggaggtcttctatttaacaggacaatctttaacagaattaaccgcacaaaaaggcgaagaaattccttatcacatcatacattttgctatcgcacctgaacgagctgttttgcaccaacgcattgaacaacgttttcataaaatgatcgaacaaggctttcaacaggaagtcgaaaaactttatcaacgctcggatctacaccctaatctaccctctattcgttgtgtcggttatcgacaaatgtgggaatatttacagggtaattatgataaagacgaaatgatatttagaggtatttgtgccacaagacaattagcaaaacgacaacttacttggttacgtggttggaaatcgcccatagaatggctagacagcctaaacccaaaaagtgcgaaagaaaaaatcataaaaaccataaaacataactgtaaataaagttcacaaaatcgtttttttctataaaaatttaggataaaatggctcgaatttttacttgacaaacaaaatagaatagaaaaaatgacagcctacagcctacagcctacagcctacagcctacagcccacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagccyacagcctagtatattgsctaaaatcaacctttcaagttaattttgagaggttggacatgttcaaacaayatcttaaaaatcacctatttcaacctcaacctttcggcgaarrtayyattcgcctttttttgttgtgtcttaaaaagcaaggcatcgccgatttatttatcaatctatctaaaaagtaacacgtttaatcaataaacaaccgtaaaaaagttaaaaaaatcaacaaaataaatcaataaaaaaacctaattttaaaagcttaaagagagtgaatttatgaacaaaatcttcaaaacmaaatacgatgtaacaacaggtcaaacgaaagttgtrtctgaattagcgaataaccgycaagtggcgagccgtgttgaggcgtcggggcgtcagccgaagtgcggtgtgtttttaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgtcggctattgctataggaactagtgcaacagctaacgctcaaaatagtgtagcgttcggaaatgaagctagcgtaagcatggaaaattcggtggcattagggaataaatcacatacaaaatatttctatcaaaatgataataacaaaaacactgccacgctcatcggaaacggcaaaaatgaggcgattgagttagccccttatgttccagagggttctagctataacttaacaaccgataaaacagcgggtattgtgtcggtaggttggacaaaggataaaagtagaaatagagaactgggcttaagacggattgtcggggtagcaccgggtgcgttggactctgacgtggcgacgattgggcaattaaaagccttagaatatgtaaaaagagaaggcttagtcgtttattatacgcaagaaaatggaaaaatatataaattagtyaaagatccacwtggtaanttntataargtmnatacgaaanatggaacaccattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcgggcatttagcgaatggagagatttccaacaaatccgatcaagcgattactggggcacaacttgatgatcttaaaggtaagttggggttgacattagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttaccatcggtttaaccgacaccccagaatttacgagtgtaaaacttacagsyrcacctacagagaacactcacgccgttaataaaaaatacgttgatgacaaaytcaaagacgtggcttcaaatatccactttatgtcagtacatacaccgaccacaacaccaaaaacaaaaggcaattacaacaacgacggtgcaaaagttgagggggcgattgcgattggtgtggacgcaagtgccgcttctgaaaactccatcgctatgggtaaaggctcgaaaattgaggcggaaatatcgaacgccgtcgctatcggggcgaataatcatctcagagggaagaataaaggtcaagataagcatacggtggctattggttcagacaatatcatcaccggacgaaaaatcgtgaatttaggttcggggaataagataggtaatactgatgataattataaaactgttaaagcagcaggtgcggtcagcatacgagtgatcggggacgataataaggttcatggagtatggaatacggtcatcggcgaagggaataaatttacagattcctcagtctatgttcatttgatgggtgataaaaataccgtcacagattctaaaaatgccatcatattaggcgataacaatattgtctcaaaattagcaaactctatcatcattggtaaaaacataactgctaaatctaatgttaaaaacgataataatttaatcgtcatgggtaaccaagcccaagcaacaaatgcgaataacagtgttgtgatcggtgcgtctgcaaaatctacagcgacaagtgcggtcgtgattggacaaggtgccgaatccaaagcccaaagtgcggtagttttaggtaaaggggcgagtgttcaagccaacgccaccggtgcagtagcgattggtgaaggggcgtctgtatctacaaatgctggtaattcgattgcgttagggaaaggatcgcaagcgacggctaaagcgaatgcaaaggcaaatgctactgtagagggcgtgaattttgcctttgcaggtgggactggaaataataagacagtattaagcataggtaaagctggaacagagcgtgtcattaaacacgtggcagcgggcgaagtgagcaaaacctcaacagatgctattaacggaagtcaattgttcagtgtgacaacggaatttgcaaaactggcaaaagatgtccttggggcggagttaggcacaactggtcaattcaaaaaatcagaatttaagacattaaaagccacaagtacgtctacggataccgcacaaaacaaaacatttagagaagcgattaatgcgaatatcgatcaaattaataaaggcttggtatttagcgacggcacaaaggatggcacaagacagctgggcgaaaagatcaccatacaagccggcaatattgacagcggtgattttgtcagtgacaacataaagacgaattacggtaccgaacaaggaaaattcctgattgggattaaaaaagatccacgttttgaaaaagtcacagtaactaaagatgttgaagacacaagtcctgaaatgaccttaaccacgaaaaaatatgtggacggaaaacttgccaatgtcgccgctaaatttaccgtcaagggcgatactaacggaacagacggcaaagggtatgaattaaataaagacaatacggaattgaatattaatggagatgctaaaaacatcaccacagaggtggataaaaccgctaaaaaattaacagtatcgcttaatagtgctttaacaggcattacatcgatcggaaaagacgagagtaacaaaatcacgtttaatggtggtacaactatcacagccggcggtgcagggttaactttagcgaatgagggtgacaaagttaaaatctcaaatgtggctgatggtacaactgctaatgatgcggtgaataaaagccaattggatacaaaacaagataaattgacaggtactatcaccgcaaataatgggctacaaattacatcgggagatggtaaaaatactgtcgctagtaacatcactttaggcttagaaactggcttaaaagacaaaatcgacaatgccttaagtaaaaccgaagcagggaatacctatgcgaaagtggatgcgtcgaatataaacaatggtaatcaaacagcatggagaaataaactagacgtctattctaaattggaaacaacgaatgaaatcgccaaagcgaaagaaacagtcacaaatggtgcaggaattacggttacagaaacggctgctggaaatggagctaaaacatttaaggttgcattagaaaatagttataaaacaaaaatagacaatataggtaccggaactgtatcagataaaaatgacaaaaccgtaacgggtggcaaagtacacgaagctattgaggcggcaaaaactgacataaaaggtaaactgtatgcaaacacagcaacatttggcttaaaaggtaatgatagtcaaaaagtgaccaaaaaattggataacactatcgaaatcaaaggcactaacacggcgaaaagcggcggaaccaacatctatgtctcgaaagccgatgaaaacggtctaaaaatcgaactgggtgaaaccttaaaaggtattacgtcgattactaagggcgataataagtctaaaatcgaatttaaagatgacagtatcgatttaacgccagttgatggtaaaactgtcactatcactaaagagggtaaaatcagcggcttgacagatggtcaaattgagaacgcctcaaaagacgtggtcacaggaaatcaattgcatgatctagcgggtaaattaggcgttagtgtggataaaaattctaaaaccggttttaccgcaccgttgtttgtcgccgtcaattatcaagggcaaacagcaactaacggaaaaactacctttaaagaagcaatcgatgatttgatcgtggctgtgaataaagggcttgtcattggcgacggtactgcaactggcacgcttcaactgggcgataccttgcagattaaagcggggaatatcgataaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaaagaatatgtggatgcgaaattagccactaaagcagggacatttaaagtgagttcggataaaggtgacacaaacaatatcaccggcactttatctgtcaaaggtaaagaagatgatgctaatggcaaacatcaaaatattaaaacagaagcgacaggatcgaatttaacgatagcacttaatagcgacttaaaaggcatatcgactattggaaaagatgataaggctaagattagctttaataaagatactgctaaaaatgagatcgagtttagtttgggagataacacgaaatataaattcgatgagaatggattagacttaggaggtaaaaaaatcaccgcacttgcgagcggtttagggttgaaagatgctgatactggaaacggaaatgccgacattattaaaaaagtcctcgagggaactcttgataatggcagtaacattaaatccactaacgccgtcaatgtaaaagacctttccaaagtcgccgaagcccttgtggaaaaaggactttcatttgaggggaatgatggaagtagtaataaagttactcgcaaactcggtgagacgttgaaaattgtgggcaaaggaagtggtgctaactcaataacaaccactgaaaataatattaaagtgtctaaaaatacagcaaacgatggactggaaattggcttgtctgatactttaataggtattaaatctgttggtaatggcgataatgcgaaaattactttaagcggaagtaatggaagcaaggacaaaattaccttcaaagcaggtagttcagaggttaccctagccgatggtaaatttagcggtgtttctgaaattaataaagaagcggataaaggagcgttgaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnggataaaggatcgttaaaactcaccgaaaacactgccactttagaaagtgcgaaagacggttcaaacctggcattgnnnnnnnnnagtgcaacgttaagtgcgggtaaagatgccggaagtattaaagtcgtcaataatggggacaagaaaatcgagttaagtccggaaaacggctcaactgttacgttgaaaaaagacacgacaaatggcggagtgcaagccascggcttatctaccatcggtaaagatgatagtaacrccttagtgtttaaaaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttagcaagtaaattgggggttgaggttgacagtgggaaaactgcgtttacagcactatcatttannnnnnnnnnnnnnnnnnnnnnnnnnnnnnnnnnnnnnnnnnnnnnnnnnnnnccaacaacctttaaaggagcgattacacagttaatcaccgcagttaatggtggattgacattcaaggggaatgatacttccccaacttcaaccacattacaattaggtggaacattgaccattgatagttcgagtgctggtagtgaaaaagacattacagcaaaactggaaccgtctaatggtagtgatcctaaagataacggtaaattaacgctgacgttaaataaagcgacatctgtagatgagaatagtgaaaaagtcgttacytctaargcggtagcracagcgttgaaaaactatacggaaacatcgaaattaggtgatacgtatttgaaaatagacgggtcgaatattggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctaaaaggtacaggtcaaaaatccgttaaagtatccgataatccggaaactaaggctgaaggggactattctattgcgattggcgataaagcagtggcaaaaaatgaaagtgcaattgctatcggctatggtgctaatgctaaaaatagaaacgcacttgccataggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgaacacacttatgtcttgggttcaagtgtcacgacagatgacaaggtaaaaaatgctgttattttaggtaatagatcaacaggtgagaaagatgccgtatctgtgggtagtgatacgcaacaaagacgaattgtttatgttgctgatccaacgagtaaatacgatgcggtgaataaaaactatgttgatgnnnnnnnnnnnnnnnnnnnnnnnnnnnnnnnnnnnnnnnnnnnnnnnnnnnnnnnnnnnacattagaaatagttggtaagggtttaaataaagctcaaactactaaatttaatggcacaaatggaaatattgccgttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctattcaaactcatgcagtcaatgttggagatttagcgaaaatttctaaggaaatagttgaaaaaggatataagtataaagctgatattccgtcaaataatagcaatgataccagcataaaactaggctcaaccatatctattgttaaatnnnnnnnnnnnnnnnnnnnnnnnnnnnnnnnnnnnnnnnnnnnnnnnnnnnnnnnnnnnnnnnnnnnnnnnnnnnnnnnnnnnaacttaatcacgcaatacaccaacgagaagggcaangccaaaatcgaaatcggctttaaagacgcaccgacatttagcaaagtgacactttctacaccgcaaatttatggtaatggtacaggtagcggaaatgctgttagtgataacgacttgattaccaaatcctaccttgacgccgcattaaaagactttaagtttaatgtggaatatggtgataagaaagtccaaatcggtcgtggcgatacsttgaartttgcagayggcttgaatattaaattagagttagcccaaaatggtactacaaaaccaagtgcgggtagttctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaagcactgctcagtcaaatggtgcaggtacaaatggcggaaatggtacaagcagtacagcttcgtcaggagctactccaagtacgacgacagccggaacagcaagcagtacaacatcgaacaccactgcggtggtgacgattggtacgactgaggacttgacaggcttgaaatctgccgagtttaacggcgataacggtaacacgactaacattaccggcaatgaaattgtgttgaaagatcaggcaggtaacgctcatacacaaacggcgacatcgcaaatcatcacggataatacagatcccgataaggaaaaagcggttgtgacaacggctgagggcgtgacaatgtctgtggtcagcgatgatcaggttctggtcaatgatcaaacagcagaagcgaatgttttaagcaatggcaagcacaccaccgaggtgaaagccggcgaggttgctattaaggataaggctggtcaggaaatcgtgagcttgaaagtggcagagggtgaaaacggtcaagatggcaagggagctacgctggcgtttgctaaaggcactgacggtaaatcgggcactggcgtaatcacgggcttgaaagacctagatgccacggctgacggttcaagtgcggygaataaaaactatgtggatgaraaagtgtcagatttggayagcaatcgtccgtttgayttctatgttaaagagggagagaamkaaaycaaagtcgtgaaaggacgtgatggtaagttctayrakcctgaagacttgaaaggggcgaagtatgatgcagaaagtaaaaaatatacttctcaagatggacaagaagttacaccggaatcggataaagtcattattcgtgctgaaccgactaccgcacctatcgggattaataatgtagcgagtggtttgggactggcagatcctgaaactgatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccatgcctgagggtgaggataaaacgaaacttcaaactcaattggaggaaaacaagaaacagcttgaaaaagctaaagaagagctagggaaagcaaaaactgctttaaccgaggctcagacagaattaacagaagccaataaagagtatgagaaaaattacggaggctatgaaaaagttgcwgasttagtgaaacmwgatagcmaaryrgatttaaccaacgyagcmacmatygstgayktgcaagcggtagcgaaatcgggcatgaagttcaagggcaatgatggtgttgaagtgcgtaaacaactcagcgaaacmytakcmatyacaggcgaagaaaatgcaagtgacgagaagtttaacagcgacmkcaccgccgccggcaatatcaaagtggaaatgkcmcaagayggcaawggcttagaagtkaaattgtctgaccagttgaagaacatgacttckttygaracwcgtgaaatkaatggyaaraaatcggtgttgaacagcaacggtttacaagcgagcagtccagacagcgaaacttttgtaaatgcacagggtacccgtattacgggcaaaggaaatcatgccggtcaatcrgcaagttayaccctcgatggcgtggcgatcacaggtaagaacggaagcgtgcagttgaatacgaccgctctttcctttgcrrycackcragaccmakctggtaracctgtcggtacaggggttatccgaggtctgaaagacttggatgcccatgctaccggygatatggcrryraayaaaaactatgtggacgaaaaagtgggtgctgccgtcaatcgcttggataatgtcatcagtaccaacaaccgaaccttacaggcaggtattgccggtgcgaatgcggcggcggcattgcctacagtaacgatgccgggtaaatcgaccattgcgttgtccgcagggacttacaaaggcagaaatgcggtagcgataggctattcacgtctaagcgataatggtaagataacgctgaaattacagggcaacagcaactctgccggcgatttcggcggtggcgtgggtgttggctggacatggtagtctagtttaaccgctataaaaaagcagtgagtaatcactgctttttttatgataaaagtttcaccgctctttttagtttttaacgttcgacaaaatcgaaaagaaaatcctattaaattaattacccttgataatgtccgacgcccagctcgtcttctttacgagtgcggttaataacgacttgcggagattgaacaatacgtaaccccatttcatcttcggtacgaactacctcacctcgtagagaattggtatagacatcagtaattttaatatctacaaacttaccgatcatgttaggcgttcctgcaaaattaactatacgatttgtttccgtacgacctgttaattccataatatcttttttcgatggaccttcaaccaatacacgttgctctgtccctaacattgctcgactaaattgtgctgcttgattgttaatgcgttgttgtagcaaatataggcgttgttttttctcttcttccgttacatcatcaggcatatctgctgctggcgttccgggacgagcagaataaataaagctaaagctcatatcaaaattcacttgagcaattaaattcatcgtgtcttcaaaatcctgatccgtttcccccggaaacccaacaataaaatctgaactaatctgaatattcggccgcacttttttcaatttgcgaataattgatttatattcaagtgcggtatgatttcgcttcattaaattcaatacacgatctgaaccgctttgcacgggtaaatgtaagaaactcaccaattcaggcgtatccgcatatacatcaataatatcatcagtaaattcaattgggtggctggtggtaaaacgtaatcgatcaattccatcaatagaagcgactaaacgtaataactcagcaaatgaacaaataccgccatcatgtgttggtccacgataagcgttcacattctgccccaataaattgacttcacgcaccccttgctctgcaagttgtgcaatttcgaataagacatcatctacgggacgacttacctcttcacctcgagtataaggcactacacagaatgaacaatatttattacagccctccatgatagaaacgaacgctgtcggtccttccgctctcggttccggtaggcgatcaaatttctcaatttcaggaaaacttacatcaaccaccgcactttttccaccacgaatttgattaatcatttcaggtaggcgatgcaatgtttgtggtccaaatacaatatcaacataaggtgcacgtgaacgaatatgctccccttcctgtgaagccacacaaccgcccacaccgattaccaagctcggattttgtttctttaattctttccaacgacctaactgatgaaacactttttcttgtgctttttcacgaatagaacaggtatttaatagcaatacgtctgcttcttccggtacatcagtcagttctaaaccatgggtatttaaaagcaaatctgccattttcgaactatcatattcgttcatttggcagccccaagttttaatatgtaatttttgtgtcatgtcagtttttaaaattaatatctaagtaaaaaatcagtcggtcattttaccgagttgttgtagctgttgccagctaaaaatcagattttattttttaaatttaaccaataacgctaaaatagcgaaaattagtctgtggagaaaacacgtatgcaaaaagatattattgttgttggtggtggtatgattggtgcggcttgtgcgacaggattagctcaattgggattacaaattcacgtcattgaacatcattctctacctgaatttgattcgacatcggagtatgacattcgcatttctgcaattagtgctgcatcagttaatttattgaaaaccctaaaggcatggcagcatatcgaaaaaatgcgtattttcccttatcgaggactggaaacttgggaaattgaaggttttgcaacccaatttcactgccaagatttacagttagcggaacttggatttatggtagaaaataatcttattcaactaggattatggcagacattttcttcctaccataatattactaccaacgtggaaaatgcgattaaaaatgttgaaaagtgcggtaaaaattggcgtatttttttatccaatggagaaagttatcaagcacctctcatcattgcagctgacggtgccaattcacaattacgccaaattgcaggcataggtttgacaggctggcaatatcgacaagattgcatgctcattttagtgaatgtagaacaagatcaacaacatattacttggcaacaattttatccctccggacctagagccttgttaccattacaaaataagcaagcctgtttagtttggtatgacagcccacaaaaaatacgtgaattaaaacagctgtcaaatgaaaaacttgcagaagaaattcatcaagcatttccccctagactgggcaaaataaacgtacaaaaatttgcgacttttgcactaacacgtcgtcatgcacaagattatttcaaacaaggtattgttttagttggcgatgccgctcacacgattaatcctcttgccggacaaggtgtcaatttaggttttaaagacgtcaaagtcctgcttagtgtaattgaaagtgcggtaaaaaataatgaagatttttcagcggatcatgttttacaacgttatcaaaaccgacggaagcctgataatttactgatgcaatcgggtatggatctgttttataaagccttcaaagaagatagcatgccattaaaaatagctcgtaacttggcattactgggtgcaaacaaaataacgcctcttaaaaaacaagctttgaaatacgcacttggtttgtaaaaaatcacctaaaaatgaaatcatcactttcaattatgagctaatcgctatatcattagccattcaaaactaagggcgcttgcaattttattgtgggctttttatttctactcaatacctgaacaaacgcaggttcattagggagaaaaccaaagctagtggaaaatacagttcaaaacaagcctattattgagcttcgttctcttactaagtcttatgatacaaaaaccattatcaataacttcaatttaactattaataacggtgaatttttaacaattctaggtccgtcaggttgcggtaaaacaacagtgttacgtttgattgccggttttgaagagttaaatgaaggtcgtattattcttgatggtgaagatgtgacggatataccggcagagcgtcgtcacataaacaccgtattccaaagttatgccctgttcccacatatgacgatttttgaaaatgtggcctttggtttacgcatgcaaaaagtaccgaatgcagacattaaacctcgtgtaatggaagcattacgcatggtgcgtctagaagaaatggcggatcgtaagccaactcagctttccggcggtcaacaacaacgtgtcgccattgcaagagcggtagtaaataaacctaaagttttattgcttgatgaatctttatccgctcttgattataaattacgtaaagaaatgcaaaatgagttgaaagcattgcaacgtcagttgggaattacctttattttcgttactcacgatcaggaagaggcattaactatgtcagatcgtattatcgtaatgaacaaaggcactatccaacaagatggttcaccacgtgatatttacgaggatcctaaaaatctatttgtggcaaaatttatcggtgaaatcaatatttttgatgcgatagttattgagcgtacagacgaaaaaactgttaaagccaatgtagaaggtcgtgtttgcgatattcatacagagttgactgtccaaccaaatcagaaattaaaaatcttgttacgtccggaagatattataattgaagaacttgatgaaaatgaaagttccaaagcaattattggacatgttgttgatcgtagctataaaggcatgacattagagtcaagcatcattcttgatcataataaaatgaaagtattggtgagtgaattctttaatgaagatgatccgcatatcgatcattcagtgggtcaaaaagtggcactaacgtggcatgaaggctgggaggttgtactggacgatgaagatgaacagtaataaatttcaaaacttaactgttagtgtcattttcggctggttactcttctttgttttagtaccaaacctgctagtcttaacagttagttttctatcaaaagatagcagtaatttttatgctttgccttttagcttggaaagttacgcaaacttagttgactcacattacgccaaagtaatgtggaattcactccgtatgtctgcgattgcaactgttatctgtttacttgtaggttatccttttgcatttttcattgccaaaataaaaccctcataccgtccatttttgctattcctcgttgttttacctttttggacgaattcgttaattcgtatttacggaatgaaaatctttcttggtatgaaaggtattttaaacaataccctaattgcaatcggtattattgacacaccaattcgtatcttgaataccgaaactgcggtaatcattggattagtttacatcttactgccttttatgattttaccgctttacgctgccattgaaaaactggatcttcgtttattggaagctgcaaaggatttgggagcaaattcatttcaacgttttattagaatcattattccattaacaatgccgggaattatcgcaggttgtttgttagttctattacccgcaatgggaatgttctatgtgtcagatttgcttggcggagcgaaagcagccctagtaggtaatgaaatttacgtccaattcttaaaaataagaaactggcctatgggttcagcaattagtatagcacttactctactaatggctttattaatttttatttactataaaacaagtaaattattaaataaaaaaatggagttggaataatgagtcgtttactacgtaatatctttttgtttgtggtatacgcttatctgtatatcccgattattattctaatcagtaattcatttaacaatgatcgtttcggtaatacttggaaaggtttcggtttccaatggtatgagcgtttattcaacaacgatactctcattcaagccgctattcattccatcactattgcattttttgcagcatcattagcaacaattattgggacattaactgctatcgcactttatcgttatcgcttccgtggtaaacaagcgataagcggaatgttgtttattgtgatgatgtcgcctgatattgttatggcggtatccctacttgcattatttatgatggtgggtatatctctaggattttggtcattgcttttagcacatgttacattctgtttaccttatgttgtagtcagtgttttctctcgtctaaaaggttttgataacaaaatgttggaagcggcaaaagatttaggtgccggtgaagtaacaatattacgcaagatcattttaccgttagcgttgcctgccattgtttcaggttggctacttagctttaccatttcattagatgatgtagttgtgtcctcatttgtcagtggtgtaagttatgaaattttaccattaaagattttctccttagtgaaaaccggggtaacccctgaagtcaatgcactggcaacactgatgattattttctctttaatcttggtaatactcagtcaacttgttgccaaaaaagggaaataataatattccaaaactgtgaaataatatttcacaaatgatcctatatcacataaaataacacgccctactttcggtaaggcgtttttattccttcaacaccgaagtatattccgcatgttaaaagtgcggtcgttttttactcttatattggagaacaatagaaatgaaaaaattttcaggtcttttcacactgggaatgatcgctgtagctctagcagcttgtaatgataaagatactcaaaaagcagagactcaagcacctgctgcttctgcaggtgatactgtttatctttatacttggaccgaatatgttcctgatggattattagaaggcttcactcaagaaacaggcattaaagtcaaccgttcaagtctagaatctaacgaaacaatgtatgcaaaaattaaaactcaaggtgccgccggcggttatgatgttattgctccatcaaactactttgtttcaaaaatggctcgtgaaggtatgctaatggaattagaccacagcaaattacctgtcatcaaagaattaaacccagattggttagacaaaccttacgataaaggtaacaaatactctttacctcaattgttaggagcaccgggcattgcatttaatacaaatgaatataaaggttctgacttcacatcgtgggctgatttatggaaacctgaatttgccggtaaagttcaattattggatgacgcacgagaagtattcaatatcgcattgttaaaattaggacaggatccaaatacacaagatcctaaaattatcgaacaagcgtatgaagagttattaaaattacgtccaaacgtactatctttcaactcagataaccctgctaattcttttatttcaggggaagtgagtattggtcaattatggaacggttctgtacgtatcgctaaaaaagaaaaagcacctttagatatggtattcccgaaagaggggcctgttctttgggttgatacgttagccattccatcaacatctaaaaatccggatgctgcacataagttaattaactacatgttaggtgcaaaaacagcagcacaactcaccttggaaattggttatccaacctctaatatcaaggcgttagaattgcttccggctgaaattactcaagatccggcaatctaccctacaactgaagttttacaaaacagttactggcaagatgacgtcggtgatgcagttcagtattacgaagaattctatcaaaaattaaaagcggcaaaataatctttgcacacaaaagaaatgctcccattggagcatttctgttttgaaaataagcttaagctaaattcccaactaaatttttcacaaattccaaccgctctttatgtgacgtcaatgacttactaaacctaaacttagtcggtccgtcaaatttaaatacagtaggctgagactgaattaattgcacaaatttcatcggatcaagttctgcattttcagaaaactcaataaatcccccattaattgtgctatcaattttgacaatttttaaggtttttgccagcaaacgcaactcagcaatttgcattaaattcttacctgcctccggtaataagccaaaacgatcaatcaactctactttcaattcatctaactctgcctgattttccgctccggcaatccgtttataaaaagataatctcatattcacatcaccaagatattcttccggtaataatgcgggtacacgtaaatcaatctctacttgctgttgtgttaaagtatccaaagaaggttctcgcccttcttttaatgcagcaacagcattttccaataattccatataaagcgaaaaaccgatactttcaatttgaccgctttgctcatttccgagcaattcaccggctcccctaatttctaaatcatgggtagccaaaataaatccggcacctaaattatctaaactttccagtgcctctaaacgcttaacggcatctttggtcattgcttttggatgaggtgtcaacaaataagcatatgcctgatgatgagaacgtccaactcttcctctcagctgatgtaattgggctaatccaaaattatccgcccgttcaataataatcgtgttagccgttgggacatcaatccctgtttcaataatagtagagcaaaccagtacattaaaacgctgatgataaaaatcggacattacacgctccaactctctttctcgcatttgcccatgcccaacaaccactctcgcttccggtacaagtgcggtcagtttttctgcacaattttcaatacttgccacatcattatgtaaataataaacctgtcctccccgtaaaatttcacgcaacacggcttctcgaataatcaaatcgtctacctgtcttacaaaggtctttatgctcaatcgccgagctggcggtgtggaaataattgataaatcacggatgccactcatcgccatatttaatgttcgaggaataggtgttgccgttagggttaaaatatcaatattggttcgtagctgtttgattttctctttttggctcactccgaaacgatgttcttcatcaataatgagcaaaccgagatcgctgaattttacttctgactgaattaatttatgcgtaccgattaaaatatcaattttaccttcattcaagtgttgtaaaatttgtttctgctcttttgccgttctaaaacgtgacaacatttcgacattaaccggcagattggcaaatcgatctttaaaattttcataatgttgctgtgccaataaagtcgtaggaaccaaaaccgctacttgtttatggttcatcacggctaaaaatgccgctctcattgccacttccgttttaccaaaccccacatcaccacaaactaaacgatccatagctttttcttggcacatatcagaaataaccgcattaattgccattttttgatcgggtgtttcttcaaaaggaaacgtggcagcaaattgtttaaattcttctttatcatattgaaatgcaaagccttttttaacttcacgttgagcataaacatccagcagttcagcagcaacatcacgaattttttctatcgctttatgtcgagcctttgcccaactatcattaccaagtttatgtaaaggtgcattttcatcagatccgccaacatagcgactaattaaatgcaaagaggtaacgggtacataaagttttgaattattcgcatattccaataataaaaactcagctttaattccaccattttctaaactcaccaatccaccatagcgtccaacaccatgatctaaatgcacaacaggttgtcctatttttaattcggcaagattgcgaatgagtatatcgggattggcaactctacgtttattacgctcacgttgttgcactcgctctcccaataattcagtttcacaaataatggcaaccttatcctcattatcaataataaatccatgttctaaactactgatgagcaggcttttagctggcttatctttttcacccaaatcctgaatttgcgttggtttgagctttaaaggtaagagtaaatccaataatgtttcccgacgcccttctgtttctactgaaaaaataacagttccgtcaaattcctcaataaactgacgcaatttttgtaaaggttctttttgttgtacttgaacggttaattccggcaacggctgcacaggtaaatttttttgacgaacagaagtgcggtccaattttttactttttaaactcaatcttggataattttttaactgccgattaacttcatcaatgcgtaaccacaatttttctggcatcagtaacggacgcatcggatcaacacgacggctttcataacgttgctcaatatcctgataaaagcgttccgcttgcggcataatttgttcaaaatccacaaacaatgtattttcaggtatgtaatcaaacaacgtcgccatttgattaaaaaagagcggttgccaatattcgattccggaaactagagttcctttactgatttgttgataaatatgttcaggatctcgtctaatttccgcaaaagtttctctaaattgactacgaaaaaagtcaataccttttctatctgttgggaactcttgtgcaggtaataaattaatacgttgaatttcctctaatgtacgctgcgtatctacatcaaaagtacgaatactatcaatttcatcatcaaaaaaatccaatcgaaaaggcaccgcacttcccatcggaaataaatccaataaagcacctcgtactgcaaattcgccatgttccagtacttgttcgactgctcgataaccggcattttccaactgtaaacgaaatctttcgatatttaatcgatcacctcgttttatcaataatacattgtgttgtaaaaattctgccggacaaactcgttgcattacagtcgtaattggtgcaataaagatacctttgttgctatgttgcaactgaaacaaggcacttaagcgagctgaaataatttcttgatgtggcgaaaaattatcgtagggtaaagtttcccaatcaggaaaaaatgtaacaggttgttgagtgaattcagttaaaaatttttctaaacagaccgcacttttaacatcaggggtcataacaaaaatcaacccatcatatcgccgtacaatttctgcaatcacaagactatcagccccctgtaatacattacctagaagtttatgctcattgggctgggtaggtatgtcaaaattaaaatacatcatattcaaatggatttatgttgaaaagttgccatgtaatttgcactgacatcttgatttaaccaaaattttccggttaaaagattgtaatgataaccacaaatatttttacagactaaatttgcttggtcagtccaatgcagtaactcagccggtttgataaatttatcgtaatcatgtgttcctttcgttaacattttaagtatgtattctgcacctaaaaccactaatgcccatgctttaaatgtgcgattaatagtcgaaaaaaataagacaccattcggttttaataaagctcggcaagactgaatgatggataaggggtcaggaacatgctccagcatttccatacaagtaatcacatcaaatttttcagcgtaaagtgcggtttgtttttgtaaaaattcttcaacggtaatttgctgataatctatgaccagtccttgttccttggcatgtaaacgagcgacttcaagaggagcaacggtcatatcaattcctgttactattgccccttgctttgccatagcctcagacaaaataccgccaccacaccccacatcaagcacttttttttccgctagtccgttagcttgctgttggatatattgtaatcgtgtcggattaagttgatgaataggtttaaaatctccattcggatcccaccaactttttgccattttttcaaatttttctaattcttgcggatcaagattttgcatttttatcagtccgtatagcagtaaaaaacaattacgctattattccttaactgcgttaaaaattcactacaaaatttcgagaaaatcagaagttatgctataatctcgccaatttttcgtacctaattaggaaatctcaatgactgattttacccccaacgttactcctgtgagtatagaagaagagcttaaatcttcgtatcttgattatgcgatgtctgtaattgtcgggcgagctttgcctgatgtacgtgacggtttaaaaccggtgcatcggcgtgtgcttttttctatggatcaaagtagcaatacttacaataaagcctacgtaaaatctgctcgtgttgtaggggacgttatcggtaaatatcatcctcacggtgatagtgcggtgtacgatactattgttcgtatggcacaacctttctcgttacgctatatgttggtggatggtcaaggtaacttcggttcggtagatggtgatgcaccggctgcaatgcgttacaccgaagtgcgtatgcaaaaaatcacccaagaattactcaccgacttagataaagaaacagtggatttttcgccaaactatgatggaaaagaaatgatccctgatgtcttgccaaccaaaattccaacattattggtcaatggttcttctggtatcgctgtgggtatggcaaccaatattccgccacataatttaaatgaagtattggatggctgtttagcctatgtggataacgaagaaatcagcattgatgaactaatgcagtatattcctggtcctgacttccctactgccgctttaatcaatggacgtaaaggaattgaagaagcatacaaaacaggacgaggaaaaatctatgttcgtgcaaaagcggaaattgaaactaacgataaaggtcgagaaaccattgttgttactgaaattccgtatcaagtcaataaagcaaaattagtagaaaaaattgcggaactcgtgcgtgaaaagaaaattgaaggcatcagtaatgtacgagatgtgtcaaataaagagggtaaccgtgttgaagtagaagttaaacgtgatgcagtcggtgaagtcgtacttaataatctgtatgccttaacccaaatgcaagtgacgtttgggatcaatatggttgccttggatcatggtcaaccaaagctattaaatttaaaacaaatcattgaagcatttgttcgccatcgccgtgaagttattactcgtcgcactgtatttgaacttcgaaaagctcgtgagcgtgcacatattttggaaggcttggcaattgccttagcgaatattgatcctgtgattgaattaattcgtgcctctaaaaccgctgatgaagctcgtgtcggtttattatctcaagcttgggaattaggtaatgtagcaacaatgctcagtgcaacaagcgtagatagttctcgtccggataatttggctgataacttaggtatcatcgacggtaaatactatctttccgatgaacaagctcgtgcaatcttagatttacgcttacaacgcttaacggggcttgaacacgaaaaaattgttactgaatatcaagaaatattaattgaaattggcaaacttttacatattctaaacagtgcggatcgtttgaaagaagtcttgtgtgaagaactggaaaaagtaaaagaagagtttggtgatgcacgtcgcactgaaattacatcggcatccggcgatattaatttagaagatcttattacccaagaagatgtcattgttacactttctcatgcaggttatgtaaaatatcaaccgcttacagactatgaggcacaacgccgtggcggtaaaggtaaatctgcaactaaaatgaaagatgaagattttattgagcgtttattagttgccaatactcatgacactattctttgcttttcaagtcgaggcagattatattggttaaaagtatatcaactaccgcaagcaaatcgaggggctcgtggtcgtcctattgttaatattctcccattacaagaaaatgaacgtattacagcaattctaccagtggctgcctatgaagaggataaatttatcgtcatggcaactgccggagggcttgtgaaaaaaattgcgttaaccgaatttagtcgccctcgttcaagcggtattattgcacttaatttacgtgatgaagatgaattaatcggcgttgatattacagatggtaccaatgaaatcatgctcttctcatcacaaggtcgagtagttcgttttgaggaaaatgcagttcgagcaatgggacgtttagcgacaggggtacgaggtattaaactggcattaacaaatgatatttccgatgatgaaagtgcggtagaaattgaggatatttctgatgaggatacaaaagaacctcttgatctgaatgtagataaagtggtgtcattggttattccaaaaaatgacggtgcaattctaaccgctacacaaaatggttatggaaaacgtaccgcactttccgagtatccaaccaaatctcgtaatactaaaggggtcatctcaattaaagtcagtgacagaaatggtaaagtggtcgctgcaacgcaagtagaggaaaatgatcaaattatgctgattaccgatgctggtacattggttcgtacgagagtgagtgaaatcagcattgtcggacgtaatactcaaggtgttcgactcattcgaacatcggaaacagaacaagtcgttagcttagaacgagtttgtgatactgatgaagatgaagaaaatatcgataacgattttgaatagagaacagactaaatcatcataatttcaagggcgattatcgccctttctttatatccaaaaaatatgactctctaccttatttatacccacttaatatgtgcttttttagcttggcattactgattattcgagggctgatacaaatggataataaatcagcaaaaatactcaatccgctcttttttcctgctttactctgtctaagtgcggtcgttttttctcggattttttcataattgaaaaatcaataaaatatgtcattatttaatccctcatttctctacaaaaaagctattttccctttttggtaaagcaaatttttttgctatactcgaacactgcttttattaggagaaacaatatggaacaaatgccgaattgcccgaaatgtcaaggtgaatacgtatatcacgacacaattaattttatttgtcctgactgtggaaatgaatggactgacaatgaaattgaacaacaagacgaagatcaactcatcgtaaaagatagcaatggaaatatattaactaatggcgatgatgtgcttttaattaaggatttaaaattaaaaggatcttcagaagtactaaaaaaaggcacaaagtacaaaaatattcgtttagtaacaggtgatcataatgttgactgcggcaaattattactaaaatctgaatttttaaagaaagcttaaattataactatcatgtttatctaaattggagttgttatgaaaaataaaattctcggcagtgcattaatgatcgccggcacaactataggtgcgggcatgttggctatgccattaacctcagccggcatggggttttccatgacgttagtgctacttgcaggattatggttattattggcctataccggcttgttgtttatggaagtttatcaaactgcaaaagaaaaagatgtcggcgttgcaactcttgcagaacaatatttcggtttaaccggacgttttttggcgactattagcttgctcgttctactctatgccttacttgccgcttatattaccggtggcggctctcttttatcaggccttttaacaggtattggtgatgacaaacaaacttctcaaatctcaatattactctttaccctaattttaggtgcatttgttgtgattggtattaaaggggttgacggcttaacccgtctcttatttatcggaaaaatcattggctttattgcggtcttattaatgatgttacctaaagcaaaattagaaaacctaggggcaattcctttagataatctattggttatttctgcaattccaattttctttacctcttttggcttccacgtcattatggggagtatcaatagctaccttgatgcagatattcgtaaaatccgtttagctattattattggaacgttaattccattatttgcctatttattatggcaattcgcaacacatggcgtattaagtcaaactcaatttgttaacctattaaaacaagatccgaccctaaatggattagtaaaagcgactagtcaaattactggaagtagcctattaggtgaggtagttcgcctattctcatctcttgcattaattacttctttcttaggtgttgcaatgggaatttttgaaggagttggtgatctattaaaacgtattaatctgccgacaaatcgcccgatactggcacttttaacttttattccgccactagcctttgctctattctatccaaacggttttatcaccgcactaggttatgccggcattttatttgccttctatgggctacttcttcctgttgctttagcttggaaagctcgtcagttgcatcccaacctaccttatagagtcgctggcggtaatcttgcattagtcatcgcatttattatgggcatcgttattatcgttatcccgttcttaatgcaagaaggtatccttcctactgttgccggataaattaaaaagagcggttaaatttttataaattcaaccgctctttctattaaattttaaaaataatgcctcacaattcatattatgaagtgttacgtttatctaaaagcaatttagtctactattttttcggtaaaacgttcaattttcgcacccaatccacgtaattttttttcaatatgctcataaccacgatcaatgtgataaatgcgatcaacgatggtttcacctgtggcaatgcaaccggctaagacaagactgatagaagcacgtaaatccgttgccataacttctgctccggataaatattcaacaccatgacaaaatgctgtgttaccttcaatctcagcctttcctcccatacgaattaattcaggaatatgcataaaacgattttcaaaaatagtctcggtaattttacttgaaccctctgcaaccatatttaataaagtaaattgagcttgcatatcagttggaaaaccaggataaggttcagtacgtatatttaccgcttttggtctattaccttgcatatccaatgtaatcgtattttccgtgacttcaattttagcaccggcatcacgtaatttatcaattactgcatctaaagttgatgctttagtatttttacaaatgatacgtccgccggaaatagccgctgcaactaaaaaagtaccggtttcaatacgatccggcacaatactatgctcacaaccgcctaggcgttcaacaccttctatcgtgataatatctgaacccgcaccgctaatttttgctcccatcttatttaaaaatacagcagtatcagtgatctcaggttcacgagctgcattttcaattactgttatgcctttcgctagagttgcagccatcataatagataaagtcgcaccaacacttactttctcaataacaattcgtttaccgattaattgaccatcaacaaaagccttaacataaccgtcttccaatacaatttttgctccaagtcgctccagcccgctgatatgtaaatcaacaggtcttgcaccaatagaacaacctcccggtaatgaaacttgcccttgtttaaaacgagatactaaaggtgctaatgcccaaatagacgcacgcatcgtcttaaccaactcataaggagctacaaaatgattaatatttgaagcgtctaaatgcaccgcaccttgttcatctcgataagttaccacacctaattgttgcagaatttttaacgtggtatcaatatcttttaactcaggtacattagttaatttgacaggctcttcagctagaatggccgcaaacaaaataggtaaggcggcatttttagcaccggaaatattcacttctccatttaaacgagactgcccataaacacgaaatttttgcatatgttacttcctacttatgctacatattcaataaacgatcacgcttccactgttcagtactgaatgtttttattgttaacgcatgaatcgcaccggatttaaaatgtgccattaaaggtgcataaatagtttgctgttgttttagtctggacagttgtgcaatttcatcgtttacaacaatgacaccaaaatgtgcattttcaccctgaacatatacttcatcgagattcaatgcttcctttaaaatttgctcaatttgctgagtttccattaatattttccactattgtaaaaaaggcttaagccaatcagataagccaaaaagatctgccaaaatttccaattgaattggggcattatgaattttttgtgaacttacttgtttttcaagctcattaataaaatcacttagcaaagcaaaaccagcactatcaatgcgattaacttcactgagctcccaaacaagttgctgaccaacaagctccgcacttgataaaagttcatcacgttgttgcaaaaaaggaagcaatgtatctcgtgataacgctcccataattcggagcgtcatcttatcactatttttttctaatgcccaattcagattgttctctttcatacgttatttactactaataataattggttgtttagaaaattcttccatctcatcaatcaaagtttctataccttttttgcgtaaaataggtaaccattcctgtcttgttgagtgaaccgtactcacaccgttagcggacatatcatacacttgccacttacctgatttactgttcttacgccaataaaactctaaatcaataggtgcaacattgccgctttgcagtattttaaccggcacattcatttgatctgccgttacattaatcggctttaatacactaattttctgattactataaagcgtcaacgctttggcatattgatattcgataaatttatcaaataccgcaaagaattttgcacgttgttccggtgatgttgatttaaaataaggccctaacactaaagatcctgcataatttacatgagcatagggcatgagtccttgacgtacgatagtacgcaaataattaggatcttgtttaatcttactttggttagtatcaatggctttaaataaacgctcagatacatcaagcgttagttcataaggtgtttcttccgccatagcttgtacagcaaaaagtgcggtcattgccacaattattttaaaaaatagtttttttaacataaatattagctcctaaatctacagtgtataaaaaattattgaacatccggttccaattgcttttgagtacttttattttctttgctgccatataagaattgcccgacaagatcctccaataccatagctgatttagtatctacaatacgacttccctcttttaacatggaagtttcaccatcatcaaatccaacgctaagggaaatatactgctcacctaacaaacctgaggttttaattgacaatgaactgttatctggaatttcattgtacttttcatctatagcaattttaaccagcggtaaataggttttatcatcaagttcaattgatgatactctgcctattacaacaccaccgactttcaaaggagctctaactttaagtccgccaatattatcaaaaacagcataaacttgataagattttgcttgattaaacccttgtatattcgcaactcttaatccaagaaaaaccaatgccccaataccaattaataaaaataatcccacccaaaattcatgtttaactgtttgtctcataaaaaatccttaattttctaccgcactttatttatgaacctgcaccaaacatcaacgctgttagtacaaaatccaatcctaaaacaacaagagaagcatgcaccaccgttttcgttgtcgctttactaattccctctgatgtcgggatacaatcatagccgttgaataatgcaatccaaacaacagcgatggcaaaacataaactcttaatacaaccgtttaataaatcatatccccagctaacggagttttgcatcacagaccaaaaactccctgcatccacacctttccaatccacaccgactaaagaaccgccccaaataccgattgcggtaaaaataacggcaagaatgggcatagaaatcacacctgcccaaaaacgaggtgaaataactcgacgcaaaggatcaactgccatcatttctaagctggataactgctctgttgctttcattaaacctatttcagccgtaagagctgagccggctcgaccagcgaataaaagtgcggttacaacagggcctaattctcgtaacaatgataatgcaactaattgtccaagacttgtttctgcggaaaaatccactaacaccacatacccttgcaaccccaacaccatgccaataaataaacccgataacatgatgattaacaaagattgtacacctaatacataaagttgtttaataagtaaggggaaatgcttcctcatctgttgtttcccaaccaatgcaccaaaaagcataaaaccggctcgccctaaagaacgacaaaaatccattccccatctacctaaagatgaaataactcggatcatgaaaacaactcctgtacatagtcttgtgcaggaaaatgaaaatgaacaggtccatcttccttaccttgaataaattgcacaacttgcggatctcggctttgtaaaagttgctccgcacttccttcagcgatcactcttttatctgcaataatatacgcataatccgcaatacttaatacttcctgcacatcatgagaaaccacaattgaagttaatcgcaacgcttcatttaaacgtttaattaagctaataatcactcccatactaatgggatcttgccctgcaaaaggctcatcgtacatgattaactccggatcaagtgcaatggtgcgagctaatgcggctcgtcttgccataccgcctgacaattccgacggcattaaatttgccgcaccacgcaaccccacagcttccaatttcatcaacacaatttgacgaataagtttttccggtaaatgtgtatgctctcgaataggaaaagcgacattatcaaaagttgataaatcggtaaataatgcgccggactgaaataacattcctatgcgttgacgaactcgatataactcactattggacattttacaaatatcttgctcatcaaacaaaatttcgcctttttcaggttgaagttgtcctccaatcagttttagcaacgtggttttaccaatgcctgacggtcccataattgcagtaattttgccttgctgtacctgcaaattgagattgtcataaataattcgattacctcgcttaaaagttaggtttctgacttctattaaaggtcttgtcatagtttcttcattactctacttatatttgtacaaaatgagatcggatattccacgaatttccggtcattgtcaaattaaattatgatgattttcaaccgcacaatccaaacgagatgtctaagttaacaccccagactttaatagattattacatgcttttttaaaaactatgctatgattacgcaatttttgtcaaacacaaaacaatataaggattttatgcatattcgctggaatattattttatcggtgatagctcttgttttactcgcttggttttatactttacagccaaatgataatgaactcagtcagcttataaagtcaagtacacagccggaatacataggagaaaagatgtcaacctctgttttttcgccaacaggaaaaaaacaatatttagcgacagcagataaaattgaacactacaatgaggatagacgcacagaatttcaccaaccgctggtctatttatttgatattgatgatgaaaaattcggtaagcaaagttggaaattaagtgctaaaaaagctaaattaacaaaaaataatatgctttatcttgatggtaacgttattgcagaaactttattggataatgctaaattacaacgagttatgacagagagtgcggtagtaaatttaactactcaagacatcacctctgacacaatggttactataaaaggtcaaaatttcagctccacaggcttaaaactgaccggaaatttacaacaacaaattgcaaccttaaaagaacaggtaaaaacccattatgaaatcaacaacaaataagtatttattaattaccgcacttatgatgacttcaatatcagctttagccctaaaagatgatacaaatcaaccgatagatatcgtatctgaccatcaatcccttgatatggaaaactctgtggtaacttttacaaataacgtagtcattaaacaagggtcaattttaattaaagcgaataaagtcgttattactcgcccaacagaaaaatccaataaaaaagaaactgttgaggctttcggtaatccggttctctttaatcaattacttgataatggaaaacctgttcagggcaaggcgaataaaatccactatgatctcagtgccgaatttttaactttaacgggtaatgcggaattaaagcaactggatagcaaaattaacggtgaaaagatcacctatgatgtcaagaaacaacaactcaaagcaaatggagccggaacatccagagtaaaaacagtattaattccgactcaattcaataatcaacacaaaaagtaaccgggtaaattaatatgtctatactgcaggcagaacatctcgctaaaagctataaaaaccgtcaagtggtttctgatgtaagtttaacagtgaactctaatgaaattgtaggtttactgggaccaaatggtgcgggaaaaaccacaacattttatatgatcgtcggtttaatacgccatgatcaaggaaaaattcacattgataacgaagatatcagtttgttgcctatgcacaaacgagcacagcgaggaatgggttatctgccacaagaagcctctattttccgacgattgagtgtttatgaaaatttaatggcagtcttggaaattcgtaaagatttaaatatgcaacaacgtcgtactcgagctgatgagctgattgaagaatttaatatcggtcatatctgtgataatttgggacaatctttatcgggcggtgaacgtcgtcgtgtagaaattgcacgtgccttagctgcaaaccctaaatttattttattggatgaaccttttgccggtgttgatcccatttccgtaattgatataaagaaaattatccaagatttacgcaatcgtggattgggtgtgttaatcactgatcataatgtgcgagaaacactggacgtttgtgaacgagcttacattgtcagctcaggaaaaatgatagcaacgggtacacctgctgaagtcatgaataacgaacaagttaaacaagtttatcttggtaaagaatttaaattgtaattatgcttaaatttactgaattactctctcctgaaaatatccgtcaagggttaacttgtacaagcaaaaaaagagcttttgaaatcatatccagcttaattgctaaacaactttcagaacaaattgatggcttagaagcagatgaagttagtcttcaagaaaaagaaactctttgtaccgattctttactcaaccgagaaaaattaggcaattccagtttgggaaacggtatggctatgcctaaaggaagattacccctaggtaatacacctatcgcagttttcttacaactgagtgcacctttaaaatatgatgcacttgatcatcgtgaagtcgatcttatttttgccttattatccccgacagaacattgttccaatctcgttcaagaattgccccatttagtagagcgtttaaaagacaaatctctaattaaacaattaagaaacgcacaaagtgcggaggaaatttggcaaatttttcaattttcagatagacaggcggaaacattaccaactactgaacaacaccatgctgaaacaaaatatcccgaggaagaataaaaatggagattatcattattagtggacgctcaggtgcaggaaaatccgtagcattgcgagcattggaagatattggctattattgtgttgataatctcacgatggatttagttcctcaacttgttgatatgttggaaaacaaacagcatttagtagcaatcagtttagatattcgtaacttacctcaagaacctgaaacattggatcacatcttaaatttgctgcaagaaaaatatccggtaaaaattattttcttggatacggatagaaataccctaattcgccgttatagcgactctcgtcgtttacatccgttatcggtccaaaatctgtctcttgaagcggcaattgctgcagaaaaagagcatcttgaacctttagtacaacatgccaatgtaattattgataccacaccgctttctccccatgaacttgctgaacgtttacgtgaatttttgcgtggcaatacggaaaaagaattacaaattattgtcgaatcttttggatttaaatatggtattcctttagatgctgattatgtttttgatgtgcgttttttaccaaatccacattggaatcaggaattacgcccaatgacaggattagaaaaaccggttatcgaatttatgcaaaaacatattgaagttgacaactttatttatcagacacgtaactatattgaaaactggttgccaatgttagaaaaaaataaccgcagttatttaaccattgcaattggttgcacaggcggtaaacatcgttctgtttatatcgctcaacaaattggtgaatatttccgagcgaagggaaagaaagtgcaaatccaacataaatcattggaaaaacatacacaaaataaataaccccaaacttaaattcggggttattttgtcagtaattatttaactcgttgtcccgcttttgcacctgcatcaacatcaagtaaatataaatccgcaccaccgttgcctgcacttaaaatcataccttcagacattccaaacttcatttttcttggtgctaagtttgcgaccataatcacaaaacgcccctccaaatcttccggcttaccatacgccgctttaattccggaaaatacttgacgagtttcattgcctatatccagtataaatttcagcaacttattactttccggcacggcttcacatttcaaaacttttgctacccgtaaatccactttgaaaaaatcatcgatagtaatgctttcttcaattggctcaaactcggaaaatgctttattttctaccgcacttttccctgcggtttggttagctttcgcattttctatttttgaagcctcgatcatttcttcaatttttttcatatctaagcgtgagaatagaggtttaaacggtgcaatttgatgatctaacaaagggcttgctacattttcccaagtcaattgcgtatttaaaaatgcttctgcacgtgctgctagatttggtaggacaggtttcaagtaacctattaatacacggaataattcaatccccattgaacacacttgttgtagttcatctgtgcgactttcgtctttggcaataacccaaggtgctttttcatcaacatatttattggctttatcagtaagtgccataatttcacgaatcgcttttccaaactcacgattttcatagtagtcggcaattaactctgactgtgcaataaattcatcgaacaacattttaccatctaatttatccgccaatttcccgtcaaaacgtttttgaataaaacttgcatttcttgaagctaaattaactaatttattcaccaaatccgtatttacacgctgtacaaaatcgtccaaatttaaatccaaatcatcgatacggctgcctaatttagcagcatagtaataacgtaagcattcaggatctaaatatttcaagtaagtggcggcttgaataaacgtccctcgagattttgacattttctcaccgttgacagtaacgtagccatgtacgaaaatattattcggtttgcgtaaactggctccatccaacatcgccggccaaaataaactgtggaaatacataatgtctttaccaataaaatgataaagctcagcatggctctctttgctccagaaactatcaaaatcaataccgctctttttgccacagagatttttaaacgatgccatataaccaatcggtgcatctaaccacacataaaaatatttattgtcagtattaggaattttaaagccaaaataaggtgcatcacgagaaatatcccattgttgtaatccagcctcaaaccattcctgcattttatttgcgacttcttgttgtaaagaccctgaacgtatccattctgttaacattgccccaaaagcaggtaaatcaaagaaaaaatgttcactttcttttaataccggcgttgcacctgatactgttgaacgtggtgaaataagttctatcgggctataagttgcagaacaaacttcacagttatcgccatattgatctgccgccttacatttcgggcaagttcctttcacaaaacgatcaggcaaaaacatcgctttttcaggatcgaaaagctgagaaatagtacgagttttaataaaaccattttgcgttaatttgtgataaattgcttcaactaactctctattttcatcactgtgagtggaatgataattatcaaaactaatgttaaaaccattaaaatcagccatatgtttttgttgcacatctgcaattaattgctcaggttttacgcccatttgatctgctttaagcatgattggtgtaccatgagcatcatctgcacaaacaaaataaatttcattgccacgcattcgttggaagcgaacccaaatatccgcttgaatatgttctagcatatggcctaaatgaataggtccgtttgcatagggtaaggcacaagtaactaaaatttgacgtgaattcgttgacattaatttaacctttaaatatgaaaattttgttgttcatcttaccttattagtggtattttttccagctctcgatactttacaatcgtagttatgctatgatgaccgtagcaatttaacttgtttctttaggaaaaaagaatatgacaatccatttttcatataacctctctgaatcacaaaaacaacagttacaagaatgtttccgacaatttagtcatactactttacaaaaagatttaattagcttaggtgcggtcaaaaaaatcgaacttggcggcaatatgttacgcatagagttagtgatgccctttgcgtggaacaccggttttgcacaattaaagaccgcacttagtgataaattagatgcaatcacacgagcaacagaaatcaaatggttacttagctatcaaattgccactctaaaacgagcaaataacctgcctgctgtaaaaggtattaaaaatattattgcggtaagttccggcaaaggcggggtaggaaaatcaacaatctccgtcaatcttgcactggcattacaaactcaaggagcaaaagtaggtatcttagatgcagatatttacggaccttccataccgcatatgctaggcgttagtcagagccgccctacttctccggataatcaacatatcgatccaattcaggcacatggcttagctgccagttccatcggttttttaatggagccggacagtgccacaatttggcgtggcccaatggcaagtagtgctttaagccagttattacaagaaacactttgggcaaatcatggcgaattggattatttggtgattgatatgcctcctggaaccggtgatattcaattaacgttatcacaaaaaattcctgttaccggtgctatcgtcgtaactactccacaagatattgcattacttgatgcaatcaaaggaatttcaatgttccaaagtgtacaagttcccgtccttggtattgttgaaaatatgtcggttcatatttgtagtcaatgtggtcatcatgaaacgattttcggaacaggcggggctaaaaaaatggcacaaaaatatcaaattaaactcttggcacaactaccgttacatattcaattacgtgaagatatggataacggtataccaactgtcatttctgctccagaaagcgaaatatcgcaatctttcttacaattagcagaaaaagtagctactgaactttattggcaaggtgaaattattcccggagaaattttattcaaagaagtaaattaatatccaagaaatttctagcgtcgggtttgtcctctcttgttcgggctatgatagcatttctctctaattcagcaaggacgcttaatagttgagttaatgctatagaaagaggggtattccgtgctgttgtatcgaacattccgtctagtgttttaaagtcgatttttctatcgtgaaattcagttataacacctataacttgtaatgcaccctgacctatctaggctagcaacaacatcccccctctcggatataattcagtaattctagcctttctgcattattttccctagttccctgaattttgcagcctgcttttttaattggtttatttggtcttttaagtcctgcttatgagttgatactccagcaaatccaacgaaagctatttttacctctattcaaaaattacataataaaaacaaatatattgattacttctattttgaagctgtttgcgagtaggtatttaaacgagaaaatttcaacacatcaaattcatcgtgtataacgtattggtaaatcagtactaaattaccttgaatatgacaatctcgctgatctttccattctccaactaatgtgtgatcttgatagctttcaggcaatggcaagcggtttaacaagcagtgcattgctgtaatatatttcgttcctactagcacatttgggtaacgttttgccaaatcagtcaaatctctagcaaattgtttagagtaactgacctttaattgtttactagacattagttacccgttaagaatgcgttttgtaaactcttcgacagaataattttctccagcttcaataaaaaagctctctgcattaccgctatctaattcgtccatagctgctaaggtttctttatttgggcgaagataattcaaatcaacagggatagagcgagtcttggcaatttgagccaaaaacatattaaatacttgtgatggtgtaagaccatattgttcaatgatctgataggcttcggatttagtttgctcaactgctctaaagctgatagacgcatttgtaagtgccataagttttctccatagtattacattgaaagactattgtggtaagaatgaagttaaaaatctacatttttaatgtgattagggattttcatttttaattgctattcaaaagttttcaatgtatatttttgaatatagtcaaaaataaaaacggagcgttacgccccgtttaatttatttttcactttcttccaattcgtctgccatcgctgataaaatttctctagaaagcaaaactaaagcacgataaaagggtaaatttgcatgcttttctacttggttaaaaaactgactagcacaaggtaacaaaaaaatttcaaatagttctcgctgggcttgaatggaatttaaattatcttcaatccaagaggcagttaaaaaaaccaacgcaaaatgatccgcactttctaccactgggcatcctcgctcttgtctaaacgaagaaaattcatccggattaattccataatcagagattttcattgaaataagtggcgtatcagtcataaataaacgctgatattctatttccagtgcgtttaaatccattggtatttgcaaactatctaacgcctctttactttgtttatctgtttccaaacaccaaacctgttccaaacctttttgttgtaaccaagaaaatacgtcagtcattataggatctgtcggttgacgataaaataaattaccgaacaatcggcttattaaggaaaaattattcatttgatctacaatcacgcaataccttccttttgtaacgctaaaagagcggtgagatttttcactgttttttctcttacttcttgcaagatatgttgcttagcttgttcatctaaaatgtgaatatcaccgaaaaaactatgatcaatatcagtaactccacaataattaaacagaccatcaactaagcaattttgtaatgattgtgcaaatccacgttcttgatatttctgtaaattattacccatagtaataaattgttgtatttttttaccatgtaaaagcccctctgaaacgccattttccgttttgtaggcaaccccatggcttaaaatacgatctaaatagccttttaagattgcaggaaatcccatccaccacaatggataaataagtgtaataagatcagattgatcgattaattcttgttcataacgaatttctgctggtgtgattttttgttgtgccgcctgtaattcttcccaagataaaatcggattgaaatcaagagcatacaaatccctaactcgtgtttcaatccccagcttttgaccggtctttacagtttgctctaatattgcttggttaaaactcgtctgattattagggtgagtaaaaataattaagtgtttcatttctttctcttattttttttgaacaatcaacgtaattccattcacagcttgaacttcaataatatccccttgttgcaaccctttaccttgaatacgccaagtggtatcgccaaaaacacctcgaccaatgccattttcggctatcacttcaaccttacctcgacatcccaacatggcgtgatctcgccggtttaaagaagaatttgcctgatctttttcatctttagtatgttgatatttccaccatgcgacactcaacactattgctaagatgccataaataacgcactgtatagtcagagataaatcaataatgatggtgatcattgaaacaataatagcggctaagccccaccataataaaaaaacgcctggaacaattatctctgcaatcaataataaaaaacctaaaatcagccaatgccaaaatgtccaagcgtcaaaccattccattttacatgtttcctctcaatagaggacgcctaagcgtccattgatattactgtttattgccttttaacaattcagcaatgcctgcaacagaaccaattaaatttccggcttcaagtggcataagtacaatcttactattatttgcactaccaatctcttttaatgcttcagtgtatttttgagcaataaagtaattgattgctttagtatctccacttgaaattgcgtctgacaccatttgtgttgctttcgcctcagcttcagcagcccgttcacgagcttcagcctgtaaaaacgcttcttgacgttcaccttcagcttttaaaattcgagactgtttttcaccctcggcacgtaaaatttcagcttgacgcacaccttcagcctctaaaatatcagcacgtttattacgttcagctttcatttgtgcattcatcgctgcaatcagctcttgcggtggacgaacatcacgaatctcaatacgtgttactttaattccccaaggattcgttgcttcatctacaatagctaataaacggctgttgatattatcacgttgagaaagcatttcgtctaattccatagaacctaataccgtacgaatatttgtcatggttaaattaatgatggcttgttcgaggtgattgacttcataagctgcacaacgagcatcaataacttgcacaaaacaaaccgcatcgatagacacattagcattatctttagaaataacttcttgcgatggaatatctaagacttgctccatcatattaatacgacgaccgacacgatccacgaaaggtacgacaaaattcaatcccggtgttaaagtgcggatataacgcccgaagcgttctattgtccaatgatagccttgaggaacggtttttaaagttgaatataaaataaatacaattaataaaataaaaataatcgtagcaattggtaacccatcaaatagctccatttcatactccttgcaaaataaaacaaacacaatataaaaatactaccagcatatagtagcttattttagtttatttatctaactaaagtgcggtctgaccaagaatataagatacttattttttagttaaattcgtgacaattttagttaattatttctttatttgacttttattaccacttaatccagtctgtttcattggtttgaccacaaccatcactacgtttttataaaaagcagtatacggtataatagtttatccatcataaaaaggtaaataccatgtctagatatgcaaaaattttattgttaaacggccctaacttaaatatgttaggaaaacgtgagcctacacattatggcaatctctctttagaagatattgaacaacgcatgcaagaattagctcaacaacatcaacttgagctaagttgctttcaagcaaatagtgaagaaaaattaatagataaaattcaccaaagctttcatctaatcgattttattattatcaatcctgcggcttatactcataccagtgttgcattacgtgatgctttgctatcagtatctattccatttgtagaagttcacttatccaatatccatagacgagaaccttttcgtcaccactcttatcttagtgatattgccgaaggtgttatttgcggattaggtgctcaaggttatgaatttgcattacaatatgcctcgaactatctaaagaaaataaaataatttgcataaattttaccgaatttcacagaaatttatcgcaaaaatttattttttcaggtaatctctcgggcgaaataattcattttaaattaaccgcacttttttatcctcaattttgtctaaattggggattttaatggcgatttatttatgaacagtattaattttagttattttaggaaatcattatggacgttcgtaaaattaaaaaacttatcgaattagttgaagaatcaggcattatggagcttgaaatttctgaaggagaagagaccattcgcattaatcgtggcacccctgtttccaatcctattcaatataatgttcctgttacagcacctacaccagtagttgctccgcctacagtttcggaagcaaccggtacgccagtaacacaagtaaatgaagagccgtcaggtcatattattcgctcaccaatggtcggtactttctatcgtagcccaagcccagaagccaaagcttttattgaaataggacaacatgtcaaagttggcgatacactttgtattgtcgaggctatgaaaatgatgaataaaattgaagctgataaagcgggaatcatcaaagcaattttagtcaatgatggcgaacctgttgaatttgatgaatctctgattgtaatcgaataattattttacttttataggatttttaccgtcctacaacattattccaagagatagattcttatgttagaaaaagttgttattgccaatcgtggtgaaattgcattacgtattctgcgtgcttgtaaagagcttggtataaaaactgttgcagtacattcaacagccgatcgtgagttaaaacatgttttattggctgatgaaactgtttgtattggtcccgcaccttccgccaaaagctatttgaatattcctgctattattgcggctgctgaagttactggtacagatgcgattcaccccggctatggtttcttatccgaaaatgcggactttgctgaacaagttgaacgctcaggttttatttttatcggtccaacagcggatgttattcgtttaatgggtgataaagtttctgcaattaatgctatgaaaaaagccggtgttccttgtgtacctggatcagacggtcctttaggtgccgatattaataaaaataaagaaatcgccaagcgtatcggctatccaattattattaaagcctccggtggaggtggtggtcgtggaatgcgtgttgtacgtgatgaaaaatcattggaagaatctatcgctatgactaaagctgaagcgaaagcggcttttaataatgatatggtttacatggaaaaatatctggaaaatccacgtcatattgaaatccaagttttagcggatacacatggaaatgccatttacttagctgaacgtgattgctcgatgcaacgtcgccaccaaaaagttgttgaagaagctccggcaccgggtatttcagaagaaacaagacgtgatattggtactcgttgtgctaatgcctgtcttgaaattggctatcgtggtgccggtacatttgagttcttatacgaaaatggtgaattctacttcatcgaaatgaatactcgcattcaagtagaacatcctgtaaccgagatgattaccggtgttgacctggttaaagagcaactgcgaatcgcagcaggatttccgctttcaattaaacaagaagacataaaagttaaaggtcatgccatcgaatgccgtattaatgcagaagatcctaagacctttttaccatcccccggtaaagtaacacacttacattctccaggtggtttcggtattcgttgggattctcatgtttatggtggatatacagtgccaccacattatgattcgatgattgctaaattaattacttatggtgatactcgtgaagtagcgattcgtcgtatgcaaaatgcattatccgaaactattatcaatggtataaaaaccaatatacctttgcataatttaattctttccgatgaaaatttccaaaaaggtggaacaaacattcactatcttgagaaaaaattgggtatgagagattaatatcactctcattgagttataaaaataaaagcaaaagtggataatagtatccacttttttatggataaaaaatgaaagtacattacaaacaatcagctaaagaatctcgctatgccttgttcttaacagtgctatatcttatcggctggtgcatttttgcctatttacctgatgaggcaagaggtccgcttggttttcctctttggtttgaattgtcttgcatatactttcccatagtgtttattatcatcgtgtatttgtgtattaagttcttttttaagaatctatcattaggagaggaaaaatgaacattaatatcattttacctttggttctctacttgctctttgtattcggcattgcttactattcctatcgtcaaagaagtcaaggcaatttcttaagcgaatattatattggtaaccgctctatgtcaggctttgtattagcgatgacgacagccgccacttatgttggagcaggatcttttataggcggaccgggtgccgcatataaattcggtttaggttgggtattgttagccatgatccaagttccggtagtcttgtttactttaggggtactgggtaaaaaattagccatgctggcacgaaaaaatcaaagtttaactgttaatgatattttattctctcgttataaaaatccctatattatcctactggcaagcctttcattgctgttttcgttctttataatgatgtccgtgcaatttatcggcataggtcgtttattagaaactacattacatatcgactaccacatttcagtactcatttttgctaccactgttggtatttacacttttataggaggctttagagcggtagtactgaccgatactatccaaggcctcatcatggttttgggaacctttttattactgggcggtgtcatttatgcaggaggcgggattagccaacttattgatcacttagctaaaattgatccgcacttaatcacgccttatggcactgatgacagaccgcttgattttacatttatggcttcgttttgggtattagtctgctttgggttactaggtttacctcatacagttgtgcgtgctattgcctataagaatagtaaggcattacatagcggtattattatcggtacaatcgtcatcgctgtactaatgctcggaatacatttagccggtgctttagggcgtgctgtaattccaaccttagatgtaagtgataaaattattcctactttgatgatacaagtattaccacctgtagttgctggtatttttcttgccgcaccaatggcggcaattatgtcatctgttgactctacattaatccaaatgtcctctactttgattaaagatctatatttacgtttttaccccgctcaaatacacaatgaaaccggaataaaacgcctatcaatattaacaactttatttctaaccttactcgttaccatagcaaccttaaatccgcctgatatgttgatctggttaaatttatttgctttaggtggactggaaaccacatttctatgggttatgttatttggcctatattggaaaaaagctaacgcttatggtgctattagttcaatgttagtcgggctaataagttacatattacttaccgctcttgacataaaattatttaatttccacgctattattcccgctttattatttggcttaattgcattcttattgggaaatcaagtaggaaataaattgattaaaaatgaggaaaaataaatggcttgggtacaacttcgtttaaacagtacaaatgaaaaagcagaaaaaatcagtgaatatttagatcatctaggtgcggtgtccgttacgtttatggacagccaagacacaccgatttttgaaccgctaccgggggaaacccgtctgtggggaaatactgatgtgattgccttgtttgatgcaaaaaccaatatgcaacaaattgtccgcctattgcaacaaaaaaatcatcttgatgaaaatactgcttataaaatcgaacaaattgaagataaagattgggaaagagaatggatggataatttccatccaatgaaatttggaaaacgcctatggatttgtcctagctggcgtgaaatacctgatgaaaatgcgataaatgtcatgcttgatcccggtttggcttttggtacaggcacacatccgacgaccgcactttgtttagaatggttagacagcttagatttaacaggaaaaactgtgattgatttcggttgtggttcaggtattttagccattgctgcccttaaattaggtgcaaaaagtgcggtcggaattgacattgatccacaagctattctcgccagttataacaatgctgaacaaaatggtgtagcagagcgtttacaattatttttatcagaagaaaaaccaaccgatttacaagcagatgtggtgattgccaatattcttgccggtccgttgaaagagctttacccgataatcagcaatttagtcaaaccacaaggtgatttgggcttatccggtattctatctacacaagcagactccgtttgtgaagcctatcaagggaaatttactcttgatccgataactgaacgagaggaatggtgccgaattaccggaaaattaaactcatttgtctaattcatttatatgattttatacaaaaaataaaagtaaatgatataaaatttaaccaatatcaaaaaaatgtaatttgtataaaaaatattctttgcaaatgacttaaaagtgcgtatcataacgcaccttgtcgccttgactagcgaaagcaataaatctgatataacataatttggagaagcagaagtgcaaattggttcttatcaattaaaaagtaatgtacttttagctcctatggcaggcataacagatcagccttttagaaggctttgttctttttatggagcaggtttgacttgctctgaaatgatgtcagccaatccacaagtttggcatacagaaaaatcaagattgcgtcttgcccatcatcaagatgcgggaattaacgctgtgcaaattgctggttccgatccgattgagatggctcaagccgcacaagtaaatgtagaatatggtgcacagattattgacattaatatggggtgcccagctaaaaaagtgaaccgtaaattagcaggatctgctcttttacaatatcctgacttagttaaaaaaattctatattcggtagtcaaagcggtaaatgtaccggtaacattgaagattagaacaggctggaatcaagagcatcgtaattgtatcgacattgcaaaaattgctgaacaagcaggaattcaagcattaagcatacatggacgtacacgtgaatgtttatttaatggaaatgctgaatatgacagcattaaaaaagttaaagaacaaatttcgattcctgttattgctaatggtgatataacaaccgcaaaacaagcacaagaggttctcagttatacgggaacagatggaataatgattggacgtggggcattaggtaaaccttggctatttcagtcaatagtaagcttaatcgaaacaggtatcactattccggagccaagtttagatgaaaagtgcagcgtgattttgcaacatattcgtgatctgcatcagttttatggtgaagataaaggatatcgcatagctcgtaagcacgtatcttggtatttagagggaattcaacctaattccgattttagacagacttttaatgcaattacgaatgctaaagcacaactaattgcactagaagatttttttaattttattttattggataaagaaacatgttagaacaacgtaatccggctgaagcattaactgtttcagtattaaattcacaatctcaagtaacaaataaaccacttcgtgattcagttaaacaagcattaagaaactatttatcacaattagacggtcaagatgtgaacgatctttatgaattagttttagcagaggttgaacaccctatgttagatatgatcatgcaatatacacgtggtaaccaaacacgtgcggcaacaatgctgggcattaaccgtggcactttacgtaaaaaattaaaaaaatatggtatgggttaatttcccttgctgaaaaaataaggtcgctaatttggcgaccttttttaattactctatttcaatttttttaataaattccgaactcaaatctaacaacggtaaatccgagccttgccaagaacgtaaaatttgataatccattaaacttaatgtatccaaccctagagtaacatttggtgtatattgttttgcgatacgagctaattgggtcaaccctaaactgctttcaatagacgagctgatcactgcttttaagcccaattgatgtgctttttcgattaatttaacacaatcttgcaacgaaccaatcaaagtaggcttaattacaattgctgctaagtgcggttctttttctaatttaaatccttgttctcgaatactttcgtcccaagctaacgctatacctgtatcctgtgcaaattgacgactatcgtcttgcgtcttacaaggctcttctaagaactgaatacgcttgcgatgttcaggctttacatatttggcaaacaactgtgctttcgacaacgtccaactacgattagcatcaagacgcaaataaagatcgggaattgcttctaacaacatatcagcaatcataccatcacgatttgcttcatacatgccaaccttaattttagctaccttctcccccggaatttgatttaatacatcataaagctcatcaggatcgccataacataacggggcgacttgatagtttccttcttgaaccaattctccttccatttcagccaaagcacaacttaagccaaaagcaacagacggatatagcccttgcaatgaaaatttttgatttgcagatcttgcctgctcccacttttttaaccattgaacagtttgctctttcgcctgttctagagtttcttggctaaattcaggcaaaggggcaatttccccccaaccttcatgctcaccacattttatttgcacaaacaacccttcacgtttcttcaaaaagcgattgcgcaaaataagctggctatccacaggaatagcatattggtataaatgaaaaattcgatttgtcattactgttcacattgttgtgtattgtcattataacgaccaccataatctaaacagtgatcttttgcatcaaaaataacgaaagtggcaaaaatacctagcaccactaaaatcagtaaaagaaacaaccattttttcaacattattttttcctcaaacaagacaaaagtgcggtcaaattttccactattcttaccgcacttttactgattaaatttatggatttcgcttaaatttactgaaatcaggtgcacgtttttcattaaacgcattgcgtccttcctgcccttcttccgtcatataaaataacatagttgcattacctgccagctcctgtaaacctgcttgaccatcacagtccgcattcaaagctgctttcaaacaacgcaaggcaatcgggctgttgcgtaacatttcacgacaccaacgcaccgtttctttttctaaatcagcgtaaggtacaactgtattgaccaatcccatttccaatgcttcttgggcattatattgacgacataaaaaccaaatttcacgtgcttttttctgcccaacgatacgagccatatagcttgccccccaaccaccatcgaatgagccgactttgggacctgtttgcccaaaaatcgcattttccgctgcaatagttaagtcgcataacatgtgtaaaacatgtccacctccaatcgcataaccggctaccattgccaccacaggttttggacaactgcgaatatcacgttggaaatccaacacatttaaatgatgcacaccgctttcatctttatagccaccgtaatcaccccgcactttttggtctcctccggaacagaaagctttttccccttgaccggtaagtacaattacaccaattttttcatcaaaacgtgcatcggaaaaggctcgaatcatctctttaactgtttgtgggcgaaaggcattacgaacctcagggcgattaatagtaatttttgcgataccgtcagtagatttatgatacaaaatatctgtataacctgaactgaaatcctgccattcaacaggcacataaagcacatcatcatttggattttgcattatttattccttttttattaagtcaatttgtggttggtattatagcttaaataccaataaaaagtgcagtcgtttttgtggaatttttacttggaacagcccattactccgtagcatattgaataaccttcgtgtatgctcatactgagttaattaatctatctgaacaaaaaaatcgcatgaataattagtcatctaaaaccgaatacaccatcttatttattctgcataattaaaaaaacgccacagttctatctgtggcgtttccaaatttgagcaaaataaattatgcttgacctttaaccgcttttaagcctaaaaacggtgctttctcacctaatgcttcttcaatgcgaattaattggttatattttgcaatacggtcagaacggctcatagaaccggttttaatttgaccagctgctgtaccgactgccaaatctgcaattgttgcatcttccgtttcaccggaacgatgtgaaataactgcagtataacctgcatctttagccattttaatggcggctaacgtttcagttaatgaaccgatttggttaaatttgatcaagattgagtttgcaatccctttttcgataccttcttttaagatcttcgtattggttacaaatagatcgtctcccactaattgaactttatcgcctaatactttggtttgatatgcaaaaccgtcccaatcagattcatcttgaccatcttcaatagatacgattgggtattcttggcataagccttctaagtagtgagtaaactcttgagaagtgaaagatttaccttcgcctttcatttcatacataccgttttctttgttatagaattcggaagaagcacagtccattgccaatgttacgtctttacctaatacataacctgctttttctaccgcttctttaatgcaagcaagtgcggcggcgttagactcaagattaggtgcgaaaccgccctcatcacctactgcggtgcttaatccttttccttttaacactttcgcaagattatggaacacttcagccccaatacgtaaagcttcttttaatgttttcgcaccgaccggttgaatcataaattcctgaatatccacattgttgtcagcatgttcaccaccattgatgatattcatcatcggcaacggcatagaatattcacctggtgtaccgttcaactctgcaatccaagcataaagaggcatacctttagaggcagctgccgctttagcatttgctaaagaaaccgctaaaatagcatttgctccaaattttgatttattttccgtaccgtccaattcaatcatgatttggtcgatttcagcttggttacttgcctcttttccaactagtgcggtagcaatttcgttatttactgctgaaacagcttttaatacacctttacctaagaaacgagctttgtccccatcacgcaattctaatgcttcacgtgagcctgttgacgctcctgatggtgctgctgccaatccaacgaaaccaccctcaagatgaacttcagcttcaacagttgggttgccacgagagtcgatgatttcacgaccaattactttaacgatttttgccattttgttttccttctatagttaatctaaaataagtataaaaactggcgatatagtaaagctatttcgtatgtttgtcttgtaaaaaagcactttttttgattttaatccatataaattgaaagaaaaaatactcttacatatttatttttgtaattttataaaattacaattatttatattgccagtatggagaatatttattaaaattctgctatgtcatttaaataaggtatagttttatgttgttaagtaatattgtggagatcagtagcggacaggcacagtttcgtctttccgaagtcagtgatccgattgcacctgtttatacttattatggtcaggcaaacttagaacaagatctctatttatctgatggttcagcagtacttcctaaagaaataaaaacttttgataaaataaccagtttactttccactggtgatgtgatttttagtctgatttcaggtaaggcaacgattgtcagcaaacaacaccaaggttttttatatactcaaaattacgttaagttaatacctaaaaatcagatagatgccaattatttagtctatttattaaacgaaaatgcggtggttaaaaagcagttaagtcgtggtttgcaaggatctcaagtattgaaatatacgactaatcagctgaaatcattgagattacccaaattaccccacttatcggaacaacgtttaatgggagagatttacctaaaacaacaaaaattagcttatctcaaacaacgcatagcgaatttagaaaaattacttgtgttacaccaattgcaaaagcgagtacagcatgactaagaaaatacccgaattaaaatttgaaaaaaccttaattgaatatctttgtacaggaacgattacggcaacggataatataattggcgaaccgcctgcggattatgtagtgcgtaccaaattgtggcaatatgagccaagcattaaaacgacggaagatttatgggaaaattttaaaagaattttagaaaagctcaatcaaaaaaccttagatcgtcctttaagtgcggtggaatttgcacaagttaaacgtactatttctaatttatccacgccttatgccgcaggacagtttctttatggcacaaacggtgtgtcacaaattgaaattgatttagatgatgatcgtcatgtgtttttaaccgtatttgaccaaaaacaaatcggagcaggcgatacggtgtaccaaattgtgaatcaaattaaacgaccggcgattattgcaggaaaagaaaatcgacaatttgatactacgttgttgattaatggcttgcccattattcaaattgaagaaaaaaaagaaacgcatgatattaacgaagccttaaatcaaatgcaccaatatatcgcggaaaatcaatacagcgatattttttctacgttacaaattctgattgcgattacaccaaacaatgtgaaatatatggcgaataccacagcggatcgctttaataaagattttgccttcaactggcaacgtcaatcggacaataaaccggtttatcactggaaagcctttgccgattccatgttgagtattcccatggcacatcaaatggcgactaactatatgattttagatggtacgccgaataaacaaaccctaaaagtaatgcgaccttatcaagtttatgctacgcgttgtgtgatggataaactcaaacgggcggatttcgatcaagcgttgaataaactcggttatatttggcataccacaggttcaggcaaaactattacgagctttaaaaccgcttggctggcaagtcgttcgccgaaagtggataaagtggtttttttagtggatcgtattgcactgactaaccaaactaccgaaaactatcgagcttatgatcctgatgccacggaagatagtctaggtagtgtactggataccaacaacaccacagatttgaaccgcaaattacatagcaaaggcagccaaattattattacctctgtgcaaaaactggataccttggttaaacgcacttctttcaaagcacccgaaaaaaacattgtgtttattgttgacgaagctcatcgttctacaggcagtgataattttgctgcgattcaaaaaaaatttaaacattctgcgtggattggttacaccggcacgccaatgtttgatgacactaccaaaggcttacgaactgaagatattttcggtgaactcttgcacgcctataccattcgagaagcaattgctgatcgcaatgtgttgggttttaaagtggattttgaaaccacgattagcgaaaaaagtatgaaagaagcgcatctaccgaaattctatcgccttaaatatcctcattggacggaagaacaaattgccttgaagattgccaatctcacgcaacaagatatggacgacagcatcgaaccgagtttttatgacgaaaatgaagaacacgtcagattagtggtggaagatattttcaaacattggaaaaatcgctccaattgggataacaaacgtaatcgtggacgatataacgccttgctgaccacgcacgtgggtggcggcaaagccagtacaccaatggcaatgatgtatttccgtgaattccaacgcatcaataaagtgcggtcagaaaagggggagtttttgctaaaagttgctgtgacctttagccaaaataccagcaataacgacaccatgcttgaaaccaaccaaggattattcgaggcaattcaacattacaacagcgaatttggcactaactttactatgtctgatgtatcggcttatactcaagatgtcaccagccgtttaaatcgcaccgctgtggacaaacaatatttagacctcgtgattgtcgtagatcagttactaacaggatttgacgcccctgaattaaatacgctttatgttgaccgcactttaaaaggtgcagggcttattcaagcctattccagaaccaatcgtgtagcggatatgcgtgaaaaaccttgggggcggattatcaattaccgctggccagcccataatgaaaagttaatgaatgaggcgttgtccgtttacgccaacaaagattccgccaaattatccgatgaagagcgaaaagtgaataataccaaggataagattactgcaccaaaatacgaagaattgctcgatgacaccaaacagattgtggaaaatctgcgagaaataacggataactttagccaattgccaccgtctgaagcgaaaaaatggaaaatgttggaacaattacgcacctataccgccaatattgccaaaatcaagcaatattctgcggaagatgaaaatggtgaaattatcggttttgattatgaaaatccggataaattgattcaagaactcggcatgaccagtgaagaagaaagtatgctcaccaacacattgtccaacgaactcaaactgcatttagcaaaaagccgaaatgtgccactgatacaaattgagctacaaatgacccacgttaaagacgtggaaattaattacgattacttaactgaattaatttccagcttgttggcacaagtagaggcaggtgaaacggaaaaagccaaagaaacggaaaaagaattggaaaaatttgccaacggcttggaagatcgcagttttgcacaacgcattaaccgtgcggcaaaagcgattatgaaaggtgtgttcaaattaaaagacgggtttaaaaaagacggcatttctattgtggaacaagcgaataacgccaaccaagatcaacaatttttggattttcgtctccaatggggattaacggaggtgattaccaacgcccaacttcgacagctttttgccaaacatcaatttcaacaaaaagatttagatgacaataatcagcttacggatttaatcaaacaagcaggtctcacttatcccgaacttgcacaaaatgatgaagtaaaaaaactgacaaaaatgaaataccgcaaccggttgcgtcataccatttacgaacttgcagatgagtttgtgggggaataaataatatggaaagaaaaatcaaatcttggaaagattatgatgacttacttaagttattgagcattcgaaaaatggatgttgaaaatcaacaacgtacattacattatttaaaaaatataggatattaccgattaagtggatactggtatccatttaagcaaaaagatgagcaaaattcccaaaaagaacaaaaaactatattactagatgagtttaaaacaggaacttgcttttcagatattttagccctttatatttttgataaacagttacgttttttagcgttagatgcactagaacgtattgaaatggcagttagaaatgatgtggtacatttattgggtaaattacatccactggcacatattgagccttatcaaatagatcaggatacaggaaaaaaagtttgttatttacatcctaattttattgcaaaaggggataaatattccaaatggaaagataagcataatcagcttattaaacgagctaggaaccgagatgctattaagcattacaatgaacaatatgccggcgtattgcctatttgggtttctgcggaagtttgggattttggcttgttatcccagttattttcagggttacggtataacgataaaaatacgattgccgcaaaatatggcgttaaagacggaaaaacatttgaacaatggctaaaaagtttaaactttattcgtaatgtttgtgctcaccatagtcgtttgtggaatttaaatatcattaatacatcggcaccactagaagaactgagttcaataaatcaatatcgtatcttcatgtacttgtgtatgatgcaaaagttattgacaataattaaccctaaatccacttggaatgagcggttatatcaattactaaacacattccctgaacctaaaaataaggcggtttcagtgcatgacataggattaccaaaagactgggaagaattagaaatttggaaaaatattaaagacaagaaatgagaactgacgcgtgcaaaagcagaggcgtcagtcatattggtgctgatagtatcacatcttatattttttgcaaaggatagaaaaacaaaatgaacaatgaaaaaagacttgtaccgaaattacgattccccgaatttactcacgcttgggaacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaacaacaaaaaatcggtacatttttcaccgcacttgatcgctacatcaccattcatcagcgtaagttggaaaatatgcaaaaattgaaaaaatcattgttgcaacagatgtttgtttaataaggggcaaagatgagctattccattgaatatacacaagaaattgatcggttaagcaaagaaaatgcctatcgactttatgattcaggcgatattcatcgcttagaagtcgggacaacgaaaggcttgcaagatattcatcgttatttatttcaagggctttatgattttgcaggcgaaattcgtgcattaaatatttctaaaggacattttcgttttgctaacgcactttatttaaaaccggcgttaagtgcggtggaaaaaatgcctgaatcaacctttgagcaaattattgaaaaatatattgaaatgaatattatccatccctttttagaaggaaatggtcgttctacacgtatttggttggatttgatttttaagaaaaacctaaaaaaagtggtgaattggcagaaagtggataaaaagttgtatttacaagcgatggagcgtagccccgtgaacgatttggaaattcgctttttattacaaaatgcgttaacggatcgcattgacgatcgtgagattttcttgaaagggattgaacaatcttattattacgaacaagccgaataaactgatttaaagtgcggtcataaatacagaattttttaataaaggaattaaatatgagcaatgtacaaacaattaccagtaaactttgggcaatggcaaatgagctgcgtggcacgatggacgcttcagaatataaaaactatattcttgcctttatgttttatcgttatttatccaaacaccaagaactatatttggtcgataatcatattttggacatagagccttcgcaaagtgtgaatgacgcttatttaacgcaagccacaggtgaggaattacaagattatttgcaagatatttcagccagtcttggttatgccattaatcccgaagatacttgggattcattaatgcggaaaatttacaatgccgaagtgatgccaagtgattatcaagccttatttgataacttcaaccaaaacgccaatttaaatgaagatgcggtggtagatttccgtggtgtgtttaatgatttgaacttaggagcttctcatttgggcaattctaccaatgagcgtgcgaaatctttaggcaatattgtgaaattggtggacgagattgaatacaaagatgatgacggtcgagatattcttggtgaaatttatgaatatttgatcgggcaatttgccgccaatgcaggcaaaaaaggcggggaattttatacaccgcaccaagtttcaaaaattttagcgaaattagtaacgctggatgtggctgataatcaagagactttccttgtttacgacccaacaatgggatcgggttcgttattattgacggtaggtaatgaattgccacaatcgaaacccattaaatattatgggcaagagctgaacaccacaacgtataacttggcacgcatgaatttgatgatgcatggcgtatcctataaaaatatgacgctatccaatgctgataccttagaaagtgactggcctgaaggacttgatgcacaagggattgatcaacctttatgtcgttttgatgctgtggtggcaaatccgccgtattccgccaagtgggacaatcacgagcgtaaattaaaagatgcccgttttcaaccttttggtgcgttggcacctgcttcaaaagccgattatgcctttattttgcatagtctatatcacttaggcgagcatggcacgatggcgattgtattgccgcatggtgtacttttccgtggtgcggcagaaggtaaaatccgtaaggcattgattggcgataacaccagcaatgcacaaggaaactatttagacgcagtgattggtttgccagcgaatttattctacggcacaagtatcccaaccacgattttggtttttaaaaagaatcgtaaaaataaagatattttatttattgatgccagccaagattttgacaagggcaaaaatcaaaaccgcttaacagacgagcatgtccaaaaaattattgacacttaccaagctcgtcaaaatgtggataaatacgcttatgtcgcttctcttgaagaaatcattgagaatgactataacctcaacattcctcgctatgtggacacttttgaagcagaggaggaaatcaatattaacgaggtgttaaaacaacttcagcaagataatcaagaaatcgaacaattagaaaaagaaatcaacgaacagttaaaattattgggagttgaacttccataacaaggaaagagataaaagaggcaaaagcctctttttttataaaattttgcataatgttaccgcacttttgagaaaaaaactcacgcttgggaacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaacaacaaaaaatcggtacatttttcaccgcacttgatcgctacatcaccattcatcagcgtaagtaatacatacaaaggagatatattatgaacgaagtaaattcaaataaagagctgttttatcaatactattcacgctggatttatatgtacaaagagggggctattagaaaagtcactatggcaaagtatctaatgacattagagtggctaaaaaaattgattccaaatctcttattgtgtgatcttaatcgcataagttatcaacaattactcaatgattatgcctgttatcacgaaaggcagaccacgatggattttcatcatcaactgaaaggtgcaattcttgatgcggtagatgaagggttattaccaagagatcccacaagaaaagccattatcaaaggtcgcccacctcgtttgaaaaaaacaaaatacttaaatcaatttgaactgcatacattaattacacaattaaatttaaccaaagaaattaactgggattggtttattttattaattgctaaaacagggatgcggttttcagaggctttggcattaacaccaaaagattttgatttttcacatcaaacactgacaattaataaaacttggaattataaagatggtggtggttttcagcctacgaaaaatcgttcatcagtacgaaaaattcctttggattggcaaactattattcaatttgctgagttaattaaaaataagcctgaagaacagcctatttttgttcgtaaaaaaatttttaattccacagtgaataatatcctgattaggcgttgtaaaaaagcaaatatcccaattatttcactacatggtttgcgacatactcatgcgtcattgttgctattcgctggggtatctattgcaagtgttgcaaggcgtttaggacattcaaatatgacgaccacgcaaaaaacatatttgcacattattcaagaattggaaaatcgagatattgatattgtaatgcgttctttatcaaatttaagttaatttagagctacgtcacttacgctgatgaatggtgatgtagcgatcaagtgcggtgaaaaatgtaccgattttttgttgttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgttcccaagcgtgagtttacataaaacaaaaaggctatcaaatgattgtatgataaccttaatgagataacttaaatttttctattttatactataattattttctctgattttccttagtcgcttttacaccacgatagccacagctactaggaattaaaatacctatgcctttcgtttcgacatcttgcgaatcaatgtatttaatattgacttcacctgtcggatttgcttcttgataaaacactttttccccattcagataaatccgcttcttgacaatcaagaaaaaattgctataaagcactctatttttgttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgttcactatgaatatgaacaattaagaagaactatcaccgcagcagcactatttgtgtctaatttttatttagctcatcgacaaggttattttgacttatctgccaatgaaaatcccattttacatatttggtcattagcagttgaagagcaatattatttgtttttccctcttttactggttattgcctataaaaaatttaaaactcatcaagtatttaaacctatagtattgggtttaatgttgctatttattttaacttcatttatccctcaatcaatttatatcaaaatcggttggagtaatacttattacatttctttcatacgttttccggagcttttaatcggatcttatcttgcattaagtaaaccaagagtaaagcctgttaataattttgttggtttcggtatttttattgcacttatcttaacgctattcttttaccataaatcaatgccgttaatgccaggcattgttctactcctaccttgtattttaaccgcacttcttattcatttctcctcccaaaactcatggggggggggggtaaaaactctcttatcattaaagcccatcgtatgggtaggtaagttatcttattctctctatctgtttcattggatttttattgcttttacgtattatatttcaggtgaaaaggaacttcctcaaggtgcaattttaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaacgtgtaagttaaaaacaacgtggcgaccacgtctaatctctgtttcttttttcatagaccaagtgtagaataataacaatctttgtattctaatttgtgcaatgttactccgtaaagcctttaagtttgaaattagaccgcatggtgaacaaatccgcaaaatcaaacaattttgtggttgttcccgttttgtgttcaataaggcattagcatggcaaaatgaacaatacgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgatctatgttgaagatttgcaagttgcgaatatgtccaaatcggcaaaaggcacagcggaagaacacggtaaaaatgtgaaacagaaatcaggtttaaaccgtgcgatattagatcagtcttggtttgagttcagacgacaactggactataaaacgcaatggcttggcggatttttagttgccgtaccagcacagaataccagtcgtgcttgcccttgttgcaaccataccgcaaaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttccacgcacttgaaaaaagcaagtgccagccgtgagaagctgaaaatgttaaaggcgaatagcacgcctcaagcgtgtttttttattcgtaatttacgcacacctaaaataaatctagcaatagatctattctcaatggtagagcgtaaagggcaaccgcttgcggttggctactttcctttatmcgtagtttctcacccctttacgctttaccgcccgaccgtgagaagtctagcggaaagccttttaaacattacaaaggaaaccgcaaaaatgctttataaattcattttattaggagaaaaccgcctaaaactttctatacgtgctaaatctgaagctgaagcacgccaacaactcaacctttctaaaaaccaagccttatttattggtcaaatcaatacaagggggcgttatgtctaatcgcaacctatcaaacgaaatcaccacgcttaaagctgcattaaaaagtttactttcaacttttcaaactagccgagcaaagcgacaagttaaaagcaaaatattcaagctataaaggagatttagacgatgagtaatacaaattatcaagcaaaccaagaaaacgcatttaagcccgatttagagggcattaagaacacattagaaacctcaagagatttaattattcagttaaaagagaaaaagcccgtaatagcttttaatgacgaggggcaagaggttcagttatctcaagaaaaaatactagacatagtactaacgaaattattctgttctattgacgatattgacgaaatacagaccgcacttttaagccttgtagcgattggagatgatagcaaaaacgatagaagaaccctaacaaaaaagccctcaaccaaatggcaagggcacaagtaatttaacttaactcataggaagtaatcaatatggagttctaaaaagaacgtcatggattatagcctaaatgagyttgaaaaggtacagaaacatgacaaaaatcaaattttcagtattgctaaaaaatcaaagtgcggttagtattggcgacactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtctatacgtcgagataaggcggagtttatccgcacgaataaggcgagccgattattagcggtagttgaagccatttcgcaccctattaacaggggcgatacaaatcacttactaactaaataattgagaacaatcaaaatgctattcaaatttatcctattcttaggcaaaaaccgcctaaaactttctatacgtgctaattcagaacaacaagcacgaaatctattaaaccttaaatctaacgctttatttatcgcacgcattaacgacaaagggggtatttatgcgtaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtaaagaaacctatattttcaaggttttcaaaaaggaaaatttataaacaatataccttgtagaatacctctggtatctaacaaactataaaaataaaacttttataatagctaacaatataggtataacaaaccaaattccataatataaaaaacggataaatctttttattattggttcagtttgttcttgatatataagttcacttgcatatatatcagataaatttttatatatttcaccattatctcccatgactatactttcatcattaaatgattcagcaatttccattaagacttttaatgaaatttcatcaggattagagagccataaactattatcatcataagatataaagaattcatactcatctttataaaaaattcttttttcataatctacggagaagcctaaactcgtcatcttgtttataacccgctcaaaatcatataatatcttatcagtgctaagtttatctgacttatttacaatagatacatgatagcccatattatttttcctgcttatctgtaactgttttataaagttctatctaacaaatcgggttattaccacattcctcaagcatagctttacggttagattcgcttatgcctttatatttctcaaaaatcgctttcggctctttaccttctttctcagcttgagccagttctctaatatcacaatagtattatatttattttgccattctttatttgtttcaatttttcatttcttgctttgtatatatttattattttataaacatatgatccgatatttttttcagacatcaaaaaatctttccatataatagttttaccatcaaaaatatctatataatcccaaagggcatccaagttatttccaaaatattctcctaattctggaacttgcttggataattgcttataaaaatcatctggagaaaaaatttcctttccttcaattattatttccatcttccaacctctttaaatgttttataatgatctgtagtaataaataataaaccgtcacttgaatataataatctcgttcctagttgtttatttctacctatattgttattaataccaatatcagcctcataccaaactcttccatctttactaggtaataagttactttcgtttctaaaaatatccccaccaatttgcccttgttttaaaggtttgccacttgaccaattatataatttttagctatatccttagttacatactcatcaggtaattttccagtttttttcaaactatcaatgactagagcagtattttgttctgcttgtaaatctaattttaatttaggatacaacgctacattctcagccccgcttgatacccttagcttagcatcctgcttctcgtaaccttttggtggtgtaacaataggctgtctagtcagatatccttttatttcccttaaagataaagaaccaccacctacagccgccccagcttcaatagccatgctggcataatgaacactacttggcaaggctgcatagctgtttgcattctcatctcctacaaaggtcgccattttacctttaaggctattacttaatccatttacataagatatcactctcaacgcagaaaggtttttataaacttcatcattccctgttcccatttgataaatatggggaagataacaaatcgggttattaccacattcctcaagcatagctttacggttagattcgcttatgcttttatatttctcaaaaatcgctttcggctctttaccttctttctcagcttgagccagctctctaatcagcttttctacctcatagttattgagatagttattctccaccgcacttttcccaatctctccactcaatgctgcattttgtacggtgttcaccgtgctatttgattgattgttttatcgggattgtaagaaaaaatatccaaatctatattttcatctgtaaatatcttagagattatatatttaaatctctcatatctgtcatagatgtcagaattatatttagttaaaagggtaaaactatcccaatttggaattatcaataattcaattattcgcataatcccaattaaaatatcttgttttatcaattttgtgtttttataggttattgctatatttatcaaatctttttctagtttccaatattcatcatcattccattctgagtaatccaaccatcttcctataaatgaattttcatcatataaccttgaataggttacatttctataaaaatctgcgtattctgccatgtttaatctccaattttatttaagttaatatcaaaagttccgtttcttgtttcttttttatttaatttttcaggactagccgcttctttccaagctcctccattatgaccatccacatctctagttatatagctattaccttttttaaacacaactgcaccagacttatcatcaaattttgttcactgactttttaaagtttgacgttttccttggttgtcaattgttttcaactctaatcccatcagctaattctaggtctaattccatatctatgatcaaatttataataattttttttgcatcattcgtaattgaaatttctctctcatataactgagtacagatcaactcaagagctataccatactcatcataattaattaaatccattgcattctcacaatcctcttcaggcaaatttttataaagcaaagatagtagatttttcattttttctttcattatattactcctgtttaatagggaatgcggtaattacaccatttcccattggttctacaataaccctaattctaacgccatcaacaactccctcaactttaaatctactcggaacaccctttttagtatacaaacttccttttgttcctgtttgttgtacccattctaaattaggatcagtagcaatattagatataacgtcgagaatttttttctcagaccagtgtattgggaatttagattttccattcagaatatttgtaaaagaaaatttatgcccaccacctgttttatctccatataatatatgttcagctctctgagaactgactagagataccatattttctctagcagttattagattagagacatttttagtaacaactttttgaaatacatttatagcttcacccgtcaataaaatactcggtgcttccaacgatttacccagactaagcatatagccttgcatttctgcggctaacatagagtcgttttctaaagcccaatttaactgctcattccattgttccgctgaaatcaccactttatcaaaggtctctttcgggttttggattacattcgccagtgttgcaacggttttatcaagatttactatcccatcaactgtgccttgtacaccttctacaaccgctttagcttccccaattttcattgcatcataataagcttccgctaattcctccgcattttctttatctttgaaaagcgttttggcaaacatttctatcgattgcttacgttcttctgatgggtgaatgtcatcaccaagaaaattaaactccaccgcattctcagccaccctcattcccgtactcactgtcgccaatgtaccggctgcggtatcactgcctgcagctacaccacctgccacacctgcaatccctttgataacctgaataagttcttgcttttccatttccgtcagttctgttggggatttgccatagacggtttcgcttaagattttcgcacccacttcacccacgcctgtagccactgcacctgccgtcgcactactgcttgataactgggcttccattactccccataaaatatgagcaggaatatttaaggcttgtaactcagggctgtctgtcactttcttaatcgcttcattcacataaggcgatacggcacctgctacaaccgcttctgtcggtttccctgcaacaataaggcttaatgccgcagcgactgcggttgccgcctgtttcttgttaccacccgtttgccattcttttgcagcttgttggtaagcggtagcttcttgggctttttgggttgcagtaacaaggtcgccttcttcagccgctttcgttgcctcttgctctgcttgttttgctttttcctccagttccgctgcttgccggctggcataggtcatcaccgcacctgcaacattgcctgcctcttgtgaaaggatttgttgttctttcaacaccttattaatgtctttcggtgcttcaacctgtttattcgccttatcaagttcggtattaatccccaacgcttttgctgtggtttggattggatttgtgtctttgtttaaggtgatttccccctcggtgatagtggttttggtgattgagctgtcattactttgactatgcatcggtaagctcggggttatgttcggagcggtttttccttcaaccaacatcgcattttctgctcctttgccgtaagtgcctgagattgaaacacttgttgccttatgacttgatttatttcgaatgtcattaaaagtaaggcgattggttcgcagttcactgttgtttggggtagttgaagcaatggtgccgcctttcaagtggatgttgtttgcttctatatgataaccgcctttgcctgcaattaaacctgcctgttcattaacttgtttataactgcttttgcctttctcacctgaagcaaaaccactcacactccaagcattaccaaaactcacatctacactaatccctgcctgactgcctttgctgttgtaattgttgmtgtcttgcttgctttcaatccgaaggtcgcctttagcattcacatcaattcgctcagcagtagcggttgtgccgttgagggtaatgttcccttgactgttaaacttaatatgttctgcatctaaatgactgttatggtaagtggaactttcatacctacttccacaccaacgttctgtcctcagatttccatttactcccctttggatttattttttatccttactctttcctcccatatgtctagaggaacgaaatattcattctcagcctcttcttttgtgagatcacttattcctttcatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacaccgcctgcaaccgctcctgcgattgaagctaaagcgataatatgttgccgttcttctgccgtcagttggctagcttcggttttattgtatagtaatttcgccaaggttggtgcagcaagttctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtccctatcgcccccgcactttgattcgctaatacaccggttaaaacagtggtcaataccttggctgttctgttgtatgtgccattgttatcccattgcttttgggattgtgtcgctttaataagtgcggtcagttttgcttcgatttctgatgagcttgcattcggattcgcttgcacttgttctaaggcttttttcgcctctttcactttctgtgtagcttccgcttgtttatttgccgtgtaggtttgcactgccgaactaatatgccccaccgcctgaacaatctccttttgctccgccagtagttttttcacctcttttggttttgccacttggctgtttgcttggctaaggtcggtattaaatcccaacgcttttgctgtggtttkgattggrtttgtgtctttgtttaaggtgatttccccctcggtgatagtggttttggtgattgagctgtcattactttgactatgcatcggtaagctcggggttatgttcggagcggtttttccttcaaccaacatcgcattttctgctccttttttgctcagtttgccggtttcactatcttggtagtaatctgctcctttaccgtaagtgcctgagattgaaacacttgttgccttatgacttgatttatttcgaatgtcattaaaagtgaggcgattggttcgcagttcactgttgtttggggtagttgaagcaatggtactgcctttcaagtggatgttgtttgcctctatatgataaccgcctttgcctgcaattaaacctgcctgttcattaacttgtttataactgtttttgcctttctcacccgaagcaaaaccactcacgctccaagcattaccaaaactcacatctacactaatccctgcctgactacctttgctgttgtaattgttgatgtcttgcttgctttcaatccgaaggtcgcctttagcattcacatcaattcgctcagcagtagcggttgtgccgttgagggtaatgttcccttgactgttaaacttaatatgttctgcatctaaatgactgttatggtaagtggaactttcatacctacttccacaccaacgttctgtcctcagatttccatttactcccctttggatttattttttatccttactctttcctcccatatgtctagaggaacgaaatattcattctcagcctcttcttttgtgagatcacttattcctttcaaatataacattggccaactgtctgcttcttctatatatgcaaatttaacatcgaatgtaccatcattatttaaaacaaatctactttgagtccaatcactaccatttaccttcatttccgattttaaattttcataaagctctaatatatttcttttttcatgaggaatacaacctacagaataattgcattcatccccggcattatttatccaatacattctaaagcttgatatcgtttcatgaaattcacattcaaatatatacttatcagcttctgttggcattagcttccatatttcattagctattttaaaaaataaattgttacactttttgcaattcatactattctccagttggagtgttttttatcttaggaagttcaatgacttttccatttatagagtagttaatatcaaaagaatcaggtcttttactattccctctatatattggtttaatatcaacctccactttcttaccttgctctaaagcttgcttccattgcctttccatctgataccattttcctttcggtccattcaatatctcatccattgctacaagatttattttctctcctgcacctctaaacattgatgccagtaaatgtcctccgcaatcgctttctaaacgacattcccctccggttatggcttgtttagatttattctttatttttaaaaagtttattatttataaaagtttttaaaattagtgccaaatacaaccaaaaagacccccaaaatatatcactaaatgcatcattagcccaataaaaatcatcatatttaagataaatataaatcatgaaaaacacatgttttaacgaacaaaaagagacgataaaaaaataccaaattagccaataaaaaaaactattttttttcattaggtatctcctttttcaaaaatagaaacatcatctaagacgtcttctatagttcccttaagaacatctttatgtttcataattttgattttttcaattaactctccttgattaatattacgaaaaactctagctatatgagctatagataacaatgataccttttcaagttcaacatctccggatgataaaaaagaaaataatatttcttttgttttagaaggttcatcagtatacatacctaacgacaagattactttatgtttaatattattctcaacttcagaagaatttaatattaccattccatctttaaaattaatcttgtctaaagattcatatattaatttactcattttattttcctttatcatgagtataatcaaaaatatttatatgcattcctatttttggatcataatctaatcgctaacttttttcatttgatgatatgcgaccaataacctttccatacccatcactgatttctaaatttcatattatcttccttcacttaaagatgtttcacagcatcatgaatatttttaggtaataattgcatattattagggctactttgagcattatgatgccatgtataacattattaggataatatttgatagcaagccacttgatactcaacattactagtcttatatttttcgataagatttctacctcccaaattcagaacttgagcttcatttaacacatatgaacaacaagcaaattcatcatcatcatcaggattaatatacaaaattgttatattttcaggtaattgaatgaatagagaatccaacagttcatccgtatcattactatatacctctatatatctctctaatttcgtcatggttctatccttctagtaggatctgcactcttagtttgctttcctgttttataattaaattcaccaaggtgttttcctttatgattatatttctctaatgtgccatgctgagaatcccattcataaatatatccttctctatctttccatctatttcgtagttttcctccaccttgtatcgaagttttacgctttacctcagttaaacctgtaattcctgtaatttcatcttttctaggtgcagggatatatttccaatcattaggattttttgcttttttagcaaaatttgcttgtgaactagactgatttaaagcctcttctttagcaagcaaatgagctacaccaagggctaattcagcccctttttctaaagcactttgttgagctttcaagacttcaatagttttcgtattttcttcttcaactaattgatagaatttactctgttcttcaaaaggcaatccttgaatccagctattcaatgctcccgataattcatctgcaagaccaacagctttcaataattcatttggtactgttactctacattcaatctcacaattagcgaacaattccgctcgttgtttttcacttaactccctgaatttcttatgaacttcatcaacactttcaccattttgaatagctgcttttaatgctttttgatattgataaacatctttaagagaaagggcgttaaactccactgcactttycccaatctckccaccyaatgccgcattttgcaatgtatttgctgtagtgttcgattgtttgtttgcctgtgaagtaacaccacctgcaaccgcccctgcaattgaacttaaagtgataatatgttgccgttcttctgctgtcaattggctcacttcggttttgttgtacagcaatttagccaaccttggagctgccagctctgctgttgctgctgaaactgcacctgctgcggcattgccatctgcaactgttgcttcaattgctccccaagtggcgtgagccaagatattaagtggcagattaacatcaccattttcatcggttgttgcctgttttatcaggttattaaccgttggaccggcaagttttgtccctatcgcccccgcactttgattcgctaatacaccggttaaaacagtggtcaataccttggctgttytgttgtatgtgccattgttatcccattgcttttgggattgtgtcgctttaataagtgcggtcagttttgcttcratttctgatgarcttgcattcggattcscttgcacttgttctaaggatttttctgccaagtaagaataggctttatttaatattaaatttatttgatattattttttttatacataatcctataaataaaggaattgcaaaagataaaatatcacttaaagcatcttcagcccaataaaaatcaccaaatttccaatagatatatataaatatccctatatgctttaatgccgcagcagaaaatactgccaaaaataatgcaattaaataaattatcgtcttgatcattttgacaactccttgttattaaggtatttctttactttttcataatcttttactctattatcaaaatctcctccatactctccaaaagcaccgccaagaatatttccaaaggtagaatctttaaggctaaatggcttatttattataggagaaactattgcactgaaataatcgctgcctaaggtatttccactaggatcttttgataagctggttactgttgcaatacctatattaatcctaatttgattacccaatgatcgatttctggttaaagcacctcctgaaaatgcacctaacgcatcataaggattaatatcttgccctgtaactgttttatatcctacatgagctccaagcgaaatacctccatcaatcaacattccagtggtgttaggatatttagtcgaaaattctcctattacacttgcagttgtttttgccgcagatgaagctcctttagctattttaccaacgtattggacaccttttacagccgcactatgtgctcctgttcccacaaatgaaagccctgttgcaagagagttgctcaaacgtccttcaaaactttccgaatagctatatactctttgagctcttaattttaaatcagaataatccagttttatttgtggtgaatctattggtgtattcaataatctcatttgagctggtacatcgctatattcccttacccacttaaacaggatttctctatctttttgagtaagggtatcaggactggtttggtaggtatgtaataacttgtctgaaacctgatctttctttaataaatattggattagtattgcttcttcaggagttaatatttttttctctactaatctatttaatttagcatattcatgctgtgacaagaaattatttttcaccgcactttttgctgtctctgctcctaatatcgttgatgaagtattgccacccgttacattgccgacaatcaaaccacttagctgtgaagccactttgaggagtgtccgttcttcattgtttaattgctctgccgatttattgaaaaccacatccgagaggaacattgccgtagtctcacctgccacaccggcagtcgctccgacaagggcatttgtacctgatagatgtgcttcagtrgcagaaagtaaagcgtgagctaacaaattagccattttactgtcttttgtcattgtgtgaatttgtgcattcagctcmggrgaaatcgcarcarcgacaacttgcccagcastgccaccacttaaaattgcccctaccgtagcaacgacagcatcaagtttacgtmtttttgaaccgccctcttgccattccacatmttgtgtttcttttgccttgttrttggcataaacattggctgcttgactaatatrccccactgcmcgagcaatctccttttgctccgccagtrgttttttcacckctttyggttttgccacttggctgttygmttggctwarrtcggtrytaatmsccaacgcttttgctgtggtttggattggatttgtgtctttgtttaargtgattttcccttccgtaagcgtcgctttggtaacggaactgtcactgccttgactatgcatcggtaagctcggggttaygttcggagcggttttgccgtaagtgcctgagattgaaacacttgttgccttatgacttgatttatttcgaatgtcattaaaagtraggcgattggttcgcagttcactgttgtttggggtagttgaagcaatggtrcygcctttcaagtggatgttgtttgcttctatatgataaccgcctttgcctgcaattaaacctgcctgttcattmacttgtttataactgcttttgcctttytcaccygaagcaaaaccactcacactccaagcattaccaaaactcacatctacactaatccctgcctgactgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataccccactgcccgagcaatctccttttgctccgccagtagttttttcacctcttttggttttgccacttggctgtttgcttggctaaggtcggtattaaatcccaacgcttttgctgtggttttgattgggtttgtgtctttgtttaaggtgattttcccttccgtaagcgtcgctttggtaacggaactgtcwatgccttggctgtgcatcggtaagctcggggttatgttcggagcggtttttccttcaaccaacatcgcattttctgctccttttttgctcagtttgccggtttcactatcttggtagtaatctgctcctttaccgtaagtgcctgagattgaaacacttgttgccttatgacttgatttatttcgaatgtcattaaaagtgaggcgattggttcgcagttcactgttgtttggggtagttgaagcaatggtactgcctttcaagtggatgttgtttgcctctatatgataaccgcctttgcctgcaattaaacctgcctgttcattcacttgtttataactgyttttgcctttytcacccgaagcaaaaccactcacrctccaagcattaccaaaactcacatctacactaatccctgcctgactgcctttgctgttgtaattgttgctgtcttgcttgctttcaatccgaaggtcgcctttagcattcacatcaattcgctcagcagtagcggttgtgccgttgagggtaatatccccttggctgttaaacttaatatgttctgcatctaaatggctgttatggtaagtggaactttctccgttggctttttgactaccgccaccgacagtagcataaacccctacacccgtttgtgctcctgcttgagcaaacatacctacttccacgcccacattttgcccacgggatttttccttggttcgactttcgcctgcttctatttctatcttgtttgcatttagctcaatccgactgttttcaaggcggttgccgtctttgtcttttgacacaatatcagcatgctcaaggcggatattacctgtaccgctttggttgtgatttgccattgattcagttgataaagtgcggtcggttttgttactgttttgtgcgttgctttctgtgttatcacctcgagctgttagcaccacttctttgccatttaacacattcccttgactaagatgagcttcactttcctgtaattggcgactgtgagcgacacctgtgccactttctactcgtatcaaataaccggtattcggcgttttattggcaattttataaatgctgtcggctaatgtataaccctgagccgccaaacctaaggcttgtgcagtctgaagccttgtagaggcctctttgttttttaccacccgttcaactgtttggataatatcaataatcggcgatttgatgcgattaaattgtccgattttcaaatcactttgactttgttgttgtgtttgctcattatgagctgccactgcttcaatattctctgcggtaatatgcagtttgtttttcgacagtatttgacttgaggtttgatgataatccttgcctgcattgatttccacattaccattaagactgacaacttgactgccttgatgacggagactatcaccagcttgattaaaccgctcacgatgataaccaaagaaacgctctgtttctgatgtcgccacctcaccaatggcgtgattttttctcgcttggcgttgagtttgtgtggtagtcgccgtcgtaaaaagaatatcacctgtcgcactgaagctgttattgccttcacttaccaacactaaacctttacctatgatgtcgccctgttgagcagtggtttggctgtttccgcccacggaaatcaccgtgcctttttcctcaatcaacgattgcttgccgttttcacgccctttgccaacacctgctatatatttatttaacccgttaagctcaaatcccttactggaactgttcgccgattggctataacggttgatggctacatcaaaatgaacatcgccggttgccgtaaaggtcgcatctttttccacagataaagttgcaccttgggtgatgatatcgccaccggtagcgactaccgttaaattgccttgcgtgtctatgtttgcactttgagcaatcacctgttcagtttgtttgttggattgatgactttggtgcttgatgtaaggctgaatacctcgcattatcataccggtagtatccgtaatagcctctgctcgtgaaagctcatcaccaacaattccatttgtaacaccttgatctcgacgttgtttgtatttttcttttcccacctcaatcgggttatacaccatattcacaccaaccccaccggatttgctgacatagcgactttgcccaaggtgatgctcttccaccgcattgatatttaccttactaccttgaagatgcgtatcgctaccactatggatttcagtagcattcaaggttaattgatgttgagccgttactcagatattgccttttgcattcagttgtgttgcaaccagctcctcattgtgacttcgattatttgattcagttttattgcgttgatagcccaccgacacaacaccattcgaaagactaccactcaaaccgctttttttggctttctccctatagtccgtcatttttgtattgatgagtacattcaaatcaatgtcttttgcagtaatatcaatatgttgtttcgcatttatatcggtagcttcggtttttaatttatcacctgccacaagtacaatactgtcaccttttaacaagctaccctgatagttatcttgctgttcgttatagtgcgtttctttacttttcttagaaatagcattaccgcttttatagcgatgctgttcctcaagtgttgatactgttttcattgccccaaataccatctcatttgttgcaagtgcggtcagttttttcgctgtttcaatcgccgtactttgcgtgtaaagattatcggtttctaggcggatattgctgttgctttgtatccggctaataatgaggttttgattggtttcttgacggcggtggtcgcctgtccctagtttttcactgtgttgggtagaaagtgcggtgctttttaggctgtttttaatattaagcaggctgtcacctgtgccactgttaataatatcactgccgatttggttaagattgtcggcgttgatatataatgtgccgtcttcgcctttcacgtggagtaatgccttacggtcaaggtgcatgtttttataatggtacccataacttggattgctactttcatcggttttcgtggttgagcggtgtgaaaatgtgccacttacattcaaggctaatctgctttgtgcttcaatgtgtccgccttcattagttaaatcccctgatgtctgaacataaagtcgttgggcggataaggtaccttgattatgcaagctatcgccatttaactgcatcacttcccgtccgaaaatcctgccttggttaatcagttcgctgttttttgcataaatgttattcgctgaaatcaggctgccttttgtggttaatggtgaaaaatctgctttgttcgctacaagatagactttcggtaccaatacttcttgttgacttccattaggtagtgtcactgtttcagtttccagccacacaatatcggaagtcaaccttgccctttgtgctttactcagtttcacgccaggtcggagggtaaattcattcgctagagtttggctgaatttaactgccgaatccattaaggcttgatattgcacttcaaaatcttgctgatgccttgaagggagtttaccggttaattgataaagttgttctcgcacaaggcgttgttcatagtagccgtcgcctaaacgtttttgtacttgatttgagtcataacgaagagcattaaacatataatcactacttaaccatttacgataattggtaaaggctggggtggtttccactaaaatatgactgtccgcttgcggattgatttgataaagagaagaactcggtagtattgttgtcccttgtgtaaaacgaatttcacccttgccgtctgttattttaataaatggagctgtagtttgagaattgctttgtgctgtcgtagcaacggcataatccccttgagtttgactaaataccacatttaatggaatagtcacattatccacggtatggcggtcatgtcgtcctccccatttgcgttggaaatagcgtttgaaccctcctcgccattttgaccaagtaaattcgtgattaccgaattcttccgtagaatgaatgccttcttcatcagtgtttttaaacggactattttcatcttgacttactaaatttccaccggacagtattagcgaacggtcattatgcaccgcaccttgaaaccacatatcgccaccagccaatattttacccggtgcggtttgtttcaccaccgtttggctgattttgcgacggttgaggttaatgtcccaaaagcgatcatagattttgttggaaaaggcggcgttgtgcttttcaattgctttttctaattgctcaaattgtgtctcattggctttcaaccaatctaaataaggtttcagttgtaatgaaagtgcggtctgttttgcctgatattttgacttgtttgcctcataatctgctttttcggtttcatagctttgtaggcgtttagcaaaatccgcttctgactcattattttctcgagaaggtttttcgggttcattgggaatgtcaaaataagcttgtaacagatttacatcaggataatctttgaggttcaaatgtacttttttatctaaatgaatattaaaatgtgaccaagccccgtcattaggtagatacaaagaatgcggtttaatttgacaatttttcttaccagcaagattgctgcaactttcttcattcggcatcggtaagatataaccgttaaagttgccattggtttctctctcttttaactcagttgctcgagatgctactttaccggctcgactaaaagatatccaacgcaaggtgttaaaatcaattttggcagaattaggttgtccttcaggtaataaataatgttcatttaattgggtatcactttgtaattcaaacgctgtttttaaatgttcgttactattgattaaggatttcactccaaaataagcattgccagccacatcaatcaacccactttgatttttaaaattatcggcaaaagatgagttttcagaagataactcgacttcctcagttgaattcaaacggcgaccgacaaacaaattaccctgactcaacagacttggaccttccgtgatttgaccgttttgcttttccgctatggtcaaaaattgtttttggtttatcagttcaggtgctgccaaatccaatcgtttatgagcggcaatgacggcagatttaacatcgttgttattgcccgatagttgctcgtctcgattgacaatacgagcaccggcttcaatggcgactttatcgcctaatatttgtcccgtgccaatattttccaccatctccgttgccttgataactgtcttttccgttcctaataccgcccctcggttaatcagagatttttcactttcaatccgattttgtcttcctcgaatcacaccgctcgaagtctgttcgatattctcttttgcttttacctcaaccctctcttctgcatacagcttgcctgcattatctaaagtgcggtcggttttaaggcggttttttgtcgctgctattatttgaccagatgtggtgttcacaatcttgccctgactatcaatcactacctctgagctacttgcaccaatatgccctgcattgcgtaccccaacgccattttctgtaccaataagataaattttgcccgaatacattccgccaagctctgctacatcaagggaaaattgcggttgtgactcgcctgaaacgtgttgggttgtgtgaataatttgcaaagttttgtcggaatcagaccgcttgatactatttttccctgtgataacggttgcttcttttttcgaccaaatccctgcattcacttctgcttctcgagcgaggatttcagtataatccacacgactgttgtccaagcctttgccgctgacattgactttaccggcttgaaccttaaaactctccacttccccgtttttaatctcaggcttgcctgtagaaagcgttactcgaccggaatttatcacaccgcaaccttcacaatgtagccctgaggggttggctataatcacatccgctttgccgcctgctacttccacatagcctttcatcacggatggcgaagaagaattgatctcgtttaaaatcactttcgcctcacctcgggcaagataaggattagccgtcacctgccctgcaagttgggtagaagtgcctgtgcgactgttatttaaaattactcctttctcggcaacatcaaattgtgaatatttattatgggaaagccctttggtattgggcgtttgaatattgacttgcggaagcccgttggtagtttgcaaaacaatgggttgttgggtttttggggcggatttatccgcttgaataattaaagtttcagcaaaagcagaagagaaaaacgaagaaaaagaaacaaactccaatgcacaaaataagctgaaacaaagaggttttaacagagctaaaaccgaagaaaaatcgaccgcactttttgaacaaacagaagacgaacatgaagatttgtcttgggattttgcaagttctgatacaacgattaaacgttgtaaggggttactaaaaataatgcaaaaatgttgtgtgttcataataaattctcctgatttttccgttttgattatcccagcctgccattcggtgtttttgtacttcaatttccgacttatcaatatagttttgcgattgacgtgaccaaagtgcggtggaaattgtggtttttctgtgactgtcacgataaatcaaataaaayaaaacaatgtgcgcttatcggtttcactttcacctgaataaatatagctgttatcaaacgcccattgatggataggatagtaaggcgattcagtataagaaagcaaaagtgattcagtaggagagatatttaggcgaatatcgggtttaggctgtgatttatcatcttttgcctgctgatgttgttgggctatatcgtttaattgagtatcaaatgtattagtgaaagtggtagtggatattacggaagaaattaagcttaaaatgagtgtttgatggcatttcataatatcaaatagaaaattatatagtcattctaagtagaatatagaatttatcattttttgcaaataatgttactcagtatttaggaaaagaagagtatggttgatattttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaactccgttttatcttttaaatggatggattttataccgaacacttcattccttttggagttttatgtcaatggggattggaatacatctgtcatctctgaatcaacttagcaaaatgcgatcccaccatatattaagtaaaactattaaattacttggtttgtatgtgaaattacattacatagttttattagttggtgctgatcgctatagtttgcatgatatttcaatgagattaagcagttgttgcaggttccattgagaataaacgtaatttattcattatataattcaataagataccgtaagcaggtacgaagaatagaatactaatgaaaattttaaataaataatctacagaaccgatttcgacccagtgttcagccataaacggatcgttacttgcgtagaaagcaataccaaagaatataaaagtatctgccagcgagccgaataccatagagcaacttggtgcaatccaccaagtttttaatttacgtaaatggttaaatacatacacatctaatagttgcccaaacaggtaagccgcaaaactggcaaacgcaatacggaagacaaatgtgttaaatgatgtaagtacatgtaaaccttgatattggctatcggaaaataatgttgaaacaagatagctgatgattagtgcggggatcataacgacaaaaataatccatcttgcttctctagcaccaaaaactcgcacggttaaatctgtggctaagaaaataaaaggaaaggtgaaagctccccatgtattgtgaaacgaaaaattctccgcaaatcctaacgttgtgagaggaatggtaatttcaaaaggaatttgaacgaggtagttgcttgccgtaatgataaatatatggaagaaactcaagatgattaatgcacgttttttttgttgatcattgaagatcgaagagatgtttttcattttgtgtacctttttgataaataaaattggggttagggaacccaatataaacatgtccaaaattggagacggagaatgatactgaattaagaaaatatttcaactaatatttacaagccaaattgctatttttttgctattctacacgacaatttttatattacatttaatggatcacagtcatgagcgaaccagaaaatcttgcacaaaatcaaccgcacttttccaaagatacaacgcattttggatttcaaactgttgcaaaatcagagaaacaaaaattagttgccaatgtttttcattccgtagcggcaaaatatgatttgatgaatgatttactttctttcggcattcatcgagtttggaaacgctttactattgattgtagcggagtgagaaaggggcataaagtcctcgatcttgctggtggtacaggggatttttccgcaaagttttctcgtatcgtaggtgaaacgggaaaagtgattttggcggatattaattcttcaatgttggacgttggacgtgaaaaattaagaaatcttggtatcgtgagtaatgttgattatgtgcaagccaatgcggaagaattaccttttgcagataatacgtttgactgtgtgataatcagtttcgggttgcgtaatgtaacagataaagacaaagcattacgttcaatgtttcgggtattaaaaccgggtggacggttgttagtgttagagttttctaaacctattttggatcctttaagtaagatctatcatttttattcttttaatgtattgccaaaaattggtgaaattgttgtgaatgatagtgacagctatcgttatctggcagaatctatccgtatgcacccgaaacaggacatattaaaagagatgatgataaatgccggttttgaacaagtcggttattataatttaaccgccggtattgtggctttacaccgaggctataaattttaggatagagtatgttgcctgattttaattctttgaaaacacagtttatgttaccgcagtttattaatgcgggatgtgaactgttattaaattatcttttgcgacggacaagtcatcgtgaaagatacttgcgtcaattacaaggtaagatcttaaagctgacattacaaaaaacacatttttctttgtatttcgttttttcagcacagcaagtggatttattgaaccattatgaaggtgaggcggattgtacagtggatattgcggtaaatttattattgcaaatgccgaaaaaatcggaaataagtcgatttattaatgataattcgcttcaatttagcggggatttgcagatattacaagattttgtggaattaatggaaatgttggaaaaagatccggcagagctgatttctccttacgttggtgatgtgattgcacatagtgcggtcagttttcttaaaaatttaacagaatcaataaagtatcagcttacgcaaagtcagcaattttgggcggagtgtttgacagaagagtggacagtactttcgcccaaattggctgtaatggatttttgcgatcaagtggaaagtttagcaaaacagaccgcacttttagaacaaaaaattaatcagattttagcatgatgaaacttaatgatattaaacgtttatataaaatagtacgtgtttttttatcttatggcattgatgaaattttaccgcataataaatatactcgttcaattcgttgttggcgaatgttatttttttggttaaaaaataaacataaaaataaagcttttggattacgtttgcgtttggctttacaagagttaggaccagtttggataaagttggggcaaatgttatcgacacgtcgtgatttatttcctgcggaaattgctgatgaattggctttattacaagataacgttgaggctttttcaggaaagattgctcgtcagcaaatagaacaagctttgggttcttctctagaaaattggtttacagattttgatgaaaatgcacttgcttccgcatctattgcacaagttcatactgcaaaacttaaattgggcgaggaacaggaaaaggaagtggtcatcaaggtgttgcgtccaaatattcagccacaaattgaggcggatttaagttggatgtataaattagccggtttactgcccaaattatttcgtgaggggtatcgtttaagagcggtcgaagttattcaagaatatgaaaaaactttgcgtgatgagcttgatttacgtgtcgaaatggcgaatgcaataaagttgcgagaaaattttcttgatagtccgatgttatatattccaaaaatgtatgaagcattttgtcataaaaatgtgattgtgatggagcgtatttacggcattcctgtttccgatgttgagacattacaacgaaacggcactgatatgaagctattggcggaaagaggtgtacaagttttttttacgcaagtatttcgtgatagtttttttcatgcagatatgcacccaggcaatatttttgtgaatccgcttcgtcctgaaaatccgcaatatattggtattgactgtggcattgtggggaaattaaatgagagtgataaacgctatttagccgaaagttttgtggcattttttaatcgtgattatcgtcgggttgcacaaatgcacgtagatgccggctggaccccacaagatacgaatattgatgatttcgaacaagcatttcgagaggtatgtgaaccgattttcgccaagcctttatctgaaatttcatttgcacaagttttactgaatttatttaatgtagcacgtgaatttaatatgcaagttcaaccgcagttagtgttattgcaaaaaacgttactttatattgaaggattagggcgtcaactttatcctcaattagatttatgggatacagcaaaaccctttttgcaaaattggttgaacgagcaaataggtatgaaggcaacatttaaaaagttgaaagccgaattgccttatttgcaggagcatctacctgattttcctgaaactttaatggacgccttgaaacaacaaaaatttattagtcagcaattagtggaaattaacaagaagttagctaaacaacaacgttggcaaaagaaaatgtttgtattaattgtgggaatagtgattttttctgtaacgttatggcaattcgctgcattgccgttggcgataagtgcggggttattcttagttggttttttagtttggctaatcggttttttgttaccttaatgcgttagatcaaaaataatccagtttagctattgtcactatgatttaaaatggttatattctgcaagattttttattaagtttaatgtcataggagaaataaaatgggattaagttggcaacaattactaattttgcttttagttgttgtggttattttcggtactaaaaaattaagaaatattggttcagatcttggcggtgcggtaaaagacttcaagaaagcaatgaatgatgatcaacctaaagatgccgaatttaaaaaaatttccgaagaggtagagcaaacttcagtcgaaaattcaaaacaaaaagagcaggcgtaatctgtgtttgatattggtttctccgaacttgttttacttttcgttgtgggcttgatagtactgggaccacagcgtttgcctgtagctgttcgtacggtaatgggttgggtaaggactgtgcgaagcttagcgacaaatgtacaaaatgaacttagtcaggaattaaaactgaaagagttacaagaaagcattaaaaaagctgaagatctcaatatttcccaattatctccggaacttagtgaaaccgtagaagaattacgtcaatcagcacaaaaaattaaaatgaatttagaggagaaagctgctgaaacaaattcttctgttgaagagcaagtgcaagaactgaaaagtgcggtgcaaaattcacagggtactgcaacgaccgaaatagaaaaaaatcttgattttccttccggtgagttatctcctgctgaacttgcagagttagcggaagagggagaacctatgttggaacttactgaatctgatttttcagaaaaggagccaacgactatctcgtctaatgaagtgattgaaaatagtaaagaaaaagtatgagtgtcgaaaagtctcagccattaattaaccatttattagaactgcgtgatagattattacgcagtatcatttttgtagtcgtaatatttctcgccttagtttatttcgcaaatgatatttataattttgttgcctcgcctttattagatgtattgcctgccggtgcgacaatgattgcgacgaatattgcgacacctttctttactccgattaagttaaccgcagtagttgctttatttatttcagtgccttttctgttatatcaagtttgggcatttgttgctcctgccttgtatcaacatgaaaagcggttggtatatcctttgctgttttccagcacattgttgttttatctcggcgtagcctttgcttattatgtggtatttccattggtatttgcttttttgactaagaccgcaccggaaggcgttgctatcgctacggatattagtagttatttggattttgttttagccctattcttggcctttgggatatgttttgaagtgccggtagccattgttttattatgctggagcggtgtgactacgccggatgacttaagaaaaaaaagaccttacattattgttgccgcattttttattggtatgctactaacgcctcctgatgcgatttctcaaacattgttggctttgccgatgtgtttattatttgagataggtgttatttgtgcgggtttttatcagccaaaagatgaacaggaaaaatcataaaaatgatttgaatttgagtgaataagattaaattattcgctctggtttgtagaaaggattggaaaatgactaaacaaatatttaccggatatcctcaacgccgtttacgtcgtatgcgtaagcaggattttagtcgtcgtttgatgtcggaaaataagctgacagtagatgacttgatttatcctgtgtttattattgagggagaaaatcatcgtgagtcggtgccttctatgcccaatgtggagaggttaacgctcgatcaacttttacttgaagcggaattgatggtgaaatacggtgtgcctgttattgcattgtttcctgtcattgaacaagagaaaaaatccttaatggcggaagaggcttataatcaagacggcttagttcaacgagcggtaaaagcattaaaagcaaatttccctgaattaggtgtactgactgatgtggctttagatccttatactgttcatggacaagatgggattattgatgaatatggatatgtactcaatgatgtaacttctgatgtacttataaaacaagccctttctcatgctcaagcaggggcggatattgttgcccctagcgatatgatggacggtagaattggtagaattcgtaccgcacttgaaaagcaaggctttgttaatacactcattatggcttattctgctaagtatgcctcaaattattacggaccatttcgtgatgctgtcggatctgcatcaaacttaaaagggggcgacaaaaaaacctatcaactggatcctgctaattctaatgagggattacaagaggttgctcttgatattgaagaaggtgcggatatggttatggttaaaccgggtatgccttatttggatatggtttatcgagttaaagatcaatttggcgtgccgacttttgcttatcaagtatctggcgaatacgctatgcacatggcagctattcaaaatggttggctaaaagaaaaagaatgtattatggagagtttactttgctttaaacgagcaggtgcggacggaattctaacttattttgctaaacaggtagcggaatggttgtatttagacgaaaagaataaataatttaaaatagattttactttaacccacttcgtgttagcgaagtgggttttgtttatctacaattgtatgtctaatttatcataggctcgagaaactttttctaacgccttatcaacagaaatatcacgtgcaagaataacacctaaacgacgatgtccattgacttcgcctttgccgaataagcgaatattagtattaggttcttgtaatacttcgaataaattaccaaattgtacttggttagatttgccttcaacgacaatcgcttttgaggcagcggggctaattaaattaatttcaggaattggtaatcctaatatggctcttgcatgaagtgcaaattcagaaagctcttgcgagattaacgtaaccattcctgtatcatgagggcgaggagatacttcattgaaaatcacttcatctccacagacaaacatttctacgccaaaaatgccacgtccgccgagttccgtagtaattttctcagcaatatgttgagccttggcgagtgcttgtacagacattgcttgcggttgccaagactcacgatagtcccctttttcttgacgatgtccgataggtgctagaaatgaagttccttctgcatggcgtacagttaataaagtaatctcataatcaaatttaacgaaaccttcaacgatcacacgaccggctcccgctcttcccccttgttgtgcatagtcccatgctttttgtaggtcgtctttgctttttaagatactctgaccatgtccagaagaagacataatcggtttgatcacacaaggaatgccaaggttttcgaccgcactttgaaagtcatcaaaattatctacaaattgataatttgatgttggcaactttaatttttctgctgcaaggcgacgaataccttcacggttcatcgttaattgtgtagctttagcagttggaacaacattaaagccggcttgctccaattcaactagtgttgaggttgcgattgcttcgacttccggcacgatataatccggtttttctttttcaattaatgctttcaaagcatctccatctaacattgaaatagtgtaagagcggtgtgcaacttgttgtgccggtgcattttcatagcgatctaccgcaatcacttctacaccaagacgttgtaattctataacgacttctttgcctagttcacctgaaccaagaagcatgacttttgttgctttaggtgttaaagctgttcctaatattgtcattttttgtccttttacattgtgttttttattaaaataagatttaagaattgagtaaattatcatctaaaagtagatcttcatttttattaatacctacgcctcgattaagaatattccgtgcaatattatgtgcatcttccaatgaatgttcagtataggttccacattgatattcgtttagttcaggaatttcggcttgatttttgacgtttaaaatatcttgcattgaagctgaccaagcgtttgcaacttgttgttcattcggcatgccaattaatgacatataaaatccggttcgacagcccatgggcgaaatatcaataatttcaatttgttcactatttaagtgatcacgcataaatcctgcaaatagatgttctaaggtatgaattcctttagatgagaggatctctttatttggaatacaaaaacgaagatcaaaaacagtgatattgtcgccttttggtgttcgcattgtttttgcaacacgcacagcaggggcattcattctcgtatgatcaactttaaaactgtcaagtagtggcataatttttcctttagagagcattaaaatagattattgaccggtattgtatttacctagaaattgtattgtaacgtattgctataacaaaaacctgattttttatgatataggtcatgatttttaatttattgtcgataattttaaattttatgtagattttctttattttattgagctttatactttttcttatcctatcaaattaattcgtcttttttttataaaaatagggtagaatagccgatcgaataattcaacataacttcgcaggagaataatcatggtaactcgtagggaattggcaaatgcaatccgttttttaagtatggatgcggtacaaaaagcaaaatctgggcatccgggagctccgatgggaatggcggatattgcggaagtattatggcgtgattttttaaatcataatccgactaatcctcaatgggcaaatcgtgatcgttttgtgttatctaacggtcatggctcaatgttaatttatagtttactgcatctcaccggttacgatctttctatcgaagatttaaaacaatttcgtcaattacattccaagactccggggcaccctgaatacggttatgcaccaggtattgaaaccacaacgggtccattaggtcaaggcattactaacgctgtaggcatggcgattgcagaaaaaacgttagccgcacaatttaatcgagcaggtcatgacattgttgatcatcatacttacgtttttctaggggatggttgcttaatggagggtatttctcatgaggcttgttcattagccggcacgttaggtctaggtaaattgattgctttttatgatgataataatatttccattgacggtcatgtagatggttggttcactgatgatacacaaaaacgctttgaggcttacggctggcatgttattcctgctgttgatggacataatgcagaacaaattattgaagcaataaaacaagctcaggctgagaaaaataaaccaactttaattatgtgtaagacgattattggctatggttctccaaataagcaaaatactcatgatagccatggggcaccattaggtgatgaagaaatcgctttaactcgtcaagcattaaattggaattacgcaccttttgaaattcctgctgatatttatgcaaaatggaatgctcacgaaaaaggacaagtggcggaaaacgcatggaatgaaaaatttgccgcttatgagaaagcttatcctgaattagcagttgaatttaaacgccgtttaaatggggaattaccggcaaactgggcaacagaaagccaagcctttattgaaaaattacaagcaaatccagccaatattgcaagtcgcaaagcgtcacaaaatgcgattgaagcgtatgcaaaattattaccggaatttttaggcgggtcagctgatttagcggggtcaaacttaacgttatggtctggttcaaaacccattcgtgcgacagaaaatatagatggtaactatattaattatggcgtgcgtgaattcggaatgtctgccattatgaatggtattgcattgcacggcggatttattccttatggtgcaacgttcttaatgtttatggaatatgcacataatgcagtgcgtatggcagccttgatgaaacaacgttcattatttgtttatacacatgactctatcggtttaggagaagacggtccgacgcatcaacctgttgagcaaacaaccgcacttcgcttaattccaaatttagaaacatggcgtccttgtgaccaagtggaatctgcaatcgcatggaaagcggcggttgaacgtcaagatggtccaagtgcattaattttcactcgacaaaatcttgctcaaatgaaccgcacttctgagcaattggaaaacgtgaaacgtggcggttatatcttgcgtgcatgctgtgaaaagggtgattgtccggatttaatcttgatcgccactggttccgaagtggaattagcgatgaaagcagcggaagtgttagatgcggaaggcgtgaaagttcgtgtagtatcaatgccgagtacgaatgtatttgataaacaagatgttgcataccgtgaggcagtattaccaagtgcggtgactaaacgtgttgcaattgaagcgggtatttcagatttctggtacaaatatgttggtaccaacggacgtatcgttggtatgaatagcttcggtgaatcagcaccggcagatcaactgtttaaactctttggcttcactgttgaaaatattgtggcaaaggcaaaagagattttataatcagttaaagtttaattttgtgagcgggtaaatttacccgctctttttcagtattatgtagcagttgtacaaagcttaatttagtatttctgctacattttttcttactctcattacaatttaaaggtaagaaaaaatgaatgccttagaaaagttattatgcgatgacgcttcaagcactaaatttacaaattaaatcaccattttcggcaagttcgctacaatccgattggtttccaaacttacggtaaccacccgtaaaaatagttccatcgggtaacgtgggttttgcatggtttcgatagcccaatcattcgcatcatttacaatgccacttgctttatcgactttcaccgattgacgttcaatcacccattccaatgcaggtttgccgttaaccacatagccgtaagcctcttcggggatattttccagcgtaaattttttgttataaatcactttagttggatcatcttcatttttgcctgtttcaagattcaagcgttttgggtgtttcattttttccacataaaaatcgctatcagcaccgccaacaatcctatcatttgaaatagataaaccgcctgtaaacaatacgccgttatacatcggcacggtttcaaaatttaaatgatagtgagctaattcacgcccagcattagaaaatgcccaaaaatcgaccgcactttttactctaggaatgcgtggcaattgcttactgagattatccgcatatttttcccgataatcttcgctatgtaataacccatagatatagtagaaaatatcttctttttggatatttttttgctcgccgtaaaattcggtgaagtgttttaaggcttcatcggtgatcgccgagcgtctttggtaagtttttggcggaatttgaccgcttgtattttgttctgtcattgtttggttatcctgttttattcgtaaatccacatcggaaaacattgtccgttcgcttgtaattgaacatcgggtatctgatcggtaataatcaccgaaaagcccttgctcgttcccagtcctgttatgcaaatcgccaaattctctactcgtagatccacatcgggaagcattgtgcatcgccgatgagatgcagatcggggatctcgttgctgatgagaattgagaatcccttgttgcctgtaactgtgaggcagatgataatgttgtctgtctgtctgtctgtctgtctgtctgtctgtattttctacgctatcaaacaaatcttttgggaaaccttgaccgcccgaatgttgcatattgagatctgggattacattcgtcattacagcagaaaattcttttcctgaatttcctgaaccgcttaaatagatcatttgatttataacattgggaacaggaaataatttgggtaactgatatggacgatggttaaatgttttatcaaaataaatatgatttttagtataaggtctatacaatccttgtcttattttatctttagagaatctttctttttctcctttacttagcttaggataaagactgctagaccaacttattttagaatcatctttatcagcaaactgtacaggatcaatttctaaatttgtttttctttgaatatttaatctatctatttcattattaaaaaatgtaatagaattattcatattttcagataatctttctttagaaaaattgtaaacccaagcatcacgatttgtctgtaatccagctgaataattttcaaatatagtaggttctttattatttttatcttttgagcctaggaccatataactatcaaaattcggatctcgttgatttagccagtcattaaactgatcgggaataatttcctgccattgttctgtttttgtaattccgttaattgaaccaaattcagcgattttttctaatttttctttttttgatagaaaatcaccaatatcataaaaatgaatattgccatttttttctttatctggatttttaactaaaatagaaatagcaactcctgtcataatatcaaaaacattttgaccttcttttttagccgaaatgccagatttaccacgaatggcacctcttaaatggaaaatataaagatcgctaaattcatcgtgtaaacatttacgtaatccatttgctgcattcgtttctaaaaaaccagcattggtaatgaaaccaattactcctttatcttgaatacgatcacttgcccaacgtatcgctttaatatagctatcataaagtgcatttttatttgttgcagttgaatgtaaagcataggtatttctaattttttcttctaataatggataacttgtgttttcattattatcatttgctgatgtttgcccaactgaatacggcggattgccaataatcacttgaatatccaattccttttgacgtttacggcgttcgctgttttctaccaaaatttgatcgatgagatcttctttttcgtacatttggaaagtatcagttaaacagataccattgaaaggttggtaagcggttggattttcgttattttttgcaagtagcgagtgataaacactttcaatgttaattgccgcaatgtaataagcgagtaagacaatttcattggcgtgaatttcattatatttttgcggtaatttttcaggcggaataatcccgctttgcaataatcgggtaatgaatgttcctgttcccgtaaatgggtctaaaatttgtacacctttatcggcaaggctagcgttaaattcattttgtagcacatcttccaccgagcggataataaaatccactacttgaattggggtgtacacaatacctaatttatcttttaattttttaaatgcttgagcaaagaaattatcatataaatctttgatgatagattgtcgtccttctggacttttgatattgctaatgcgttgctgaataccctcgtagaactcttgtaactgcttggtttctgcattggcgatattttcgccttgtaaaatagtaatagtttcacttaatgctttagacattgggttgtgttcggtgaaattatcgttagcaaataaggcatcaaaaactggtttggtaattaaatgctgagctaacatttcaatcacttcatcatcactaatcgcattatttaaatcatcacgcaattctgccgcaaaggcgttgaaagcggtgatttggcgttgattgttagggttttccaaaatcgctttaatccggtctatatgagtttgagcaatttttgccacatctgccgcccattcttcccagtgcatacgatttccacattttttcacgattttggtaactaatgctcgctcaatttcgccaatttcaaactcaaattcttcttgaattgggaaattagctcccgtgccttttgcaccgatattgtgctgatctcgccccgatttttcatattttttctttttcttgttttgatcttttggctgctttttcaaaatttgcgagatggtagaaatgacttcgattttatctttggctgcaccatcaaactgcattttgttgatcattgcatcaaagcggtcatcgtgagaacgcagagcattaagcacttgccatactactttatagttttcattattatctaaggcttcttctggcgttttcccggcaggaatcactacaggcaaaatgacataacctcgctttttgccttctgctttccgcattacacgccctaccgattgcactacgtcaatttgtgagtttcttgcagttaagaataacacggcatcaagggctggtacgtccacaccttcggataaacagcggacatttgagagaatgcggcaggtgttatattccgtttccgatttcaaccagccgattttgcctgttttttcactagcattcattgagccgtctacgtgttccgcttcacattttagttgtagcgattggttgagatcataaggtaagccctgttcttccaatgatgcaatttcttgttcttgataggcttcaactaccgtcgagaacatctctgcaatcgctttggaactcactttgtgtttattacctctgtaatttttctcaatcacttggcaaaatgctaccgcacgtttcatgggttgataatcatcggcaagatcttcttccacaccatattttgataatgctttccaacagccaacgatttttgccgcatcgtccacttggatttcattaccttctgcattcaaaagattctgcaaacggcggttaatatgcgcctcttcaacggcaagtaccaacactttataatcgactaataagccttttttcactgcggtagaaaagctgattgtaaatagttcttcgccaaaaagtgttttatcgtccattgaataaacttccaccccttcagattttttggcatcttcggtatagatgcgtggggtggcagtcatataaagacgtttttttgcttggatataatcattattgtgaatgcgaacaaatgccgattctcgcgcatcgtcaaaggtatgtcctgtagtgcggtgggcttcatcacaaatgataagatcaaaactatttaagcctaatttttgagcctgatggataacatcaattgagtggtaggtagaaaagatcacggtcattgcttcattggcatttttgcattttataccccgaattaaaccgcttgcatcggttgtggcagggtaggaaagctcgtgtaatttagtttgaactaaatcatcgttagattgtttgccgacatcactatcggaacagaccgcaaagctgtgcagttttacaccgctttcttgtgtccattcagttaaagtttgagaaagtagtgcaagacttggtacgagaaacagtacgcttttcccttgtccagccattgcttcggcaattttgagtgaagaaaaggttttaccagtaccgcaagccataattagcttaccacgatcggcagtttctaaacctcttttaactgcttttagtgcttgaatttggtgttctcttaattcctttttagcacgcaatacaaccggttgttttggcacatatttttgccaatcgatcacgctttcttcaaaattggaacggttgataatattgactggaataagttgatcagcaagggatttttctgcattttcagaccaatggtttgtcgtggtaacaattaaacgatgtgtaaaatcttttttacccgatgcagtgaaaaagctatcaatatcgcttttttgaatgcggtaatcggcagaatagtttttgcattgaatagcggtaaatgtgctatcaaaaccaacagcgactaagtcgatacctgtatcatttttatttgtgccttctggttgatatttttctacccaatcagcaaaggtgagaatttcttgatagagattcgtatattgcggttcgttggtgagatagtgttgagttaaggtttcaaaataagtgcctttttcacgctgggtttgcgaattttcttgcaggcagattaaaagttgagaaaatgctgattgattgattgattgattgattgattgattgattgattgattgattgattgattgattgattgattgattgattgattgattgattgattgattgattagacatcatattttccttttatcattgtatcaacacgctgaatttgatctgataaaggatagcaggttagtttaagttgagctagtaagagcgggtaaatttacccgcttttttttgctttttggttaagtgaagaataaaaactcaaatagaataatcgctattttgtcttaatagcattgagttagctccccctttaatgtaaactattgtcccgtctttatgggaagttgtttgttgtcaaagcaaattctccaacacttattttcataccaaaaacacataggtttaatatggctaccaattatatttttgtaaccggcggcgttgtatcttctttaggaaaaggaattgcagcagcatctttagccgcaattttagaagctcgtggcttaaatgtaactatcatgaaactcgatccttatattaacgtagatcctggaaccatgagtccgacacaacatggtgaagtttttgttactcaagacggtgctgaaacagatcttgatttagggcattatgagcgttttatccgcactaaaatgactaagcgtaataactttacaacagggaaaatttattcagaagttttgcgtaaagaacgtcgtggtgattatttgggtgcaactattcaagttattccgcatattactaatgaaattaaatctcgtgtcattgatggtgcagcaggatatgatgttgccattgttgaagtgggtggaaccgttggtgatattgaatcgttgccatttttagaggcattacgccagttagccgtccaagttgggcgtgaacggactatttttatgcatctaactttggtaccttatattccaactgccggagaggtaaaaaccaaaccgacacaacattccgttaaagagttactctcaattggtattcagcctgatgtattaatttgtcgttcagatcgcatgattccacctaatgagcgtgcgaaaattgctcttttctgtaatgtaccagaaagagcggttatttctttaaaagatgtatcatctatttatcaaattccagctttattaaaatcacaagggttagatgattttatttgccaacgtttccgtcttgattgtcaagaagcggatttatctgaatgggaaaaagtgctttatcaagaagcaaatccgacaggtgaagtcactattggcatggtaggtaagtacacggaattacctgatgcttataaatctgttaatgaagccttgaagcatgcgggattgaccaatcgtttaaccgttaatattaaatacattgattcgcaagatgtagaaacaaaaggcatagatattttaaaagatttggatggtattttaattcccggtggctttggctatcgtggtgtagagggcaaaatcttaacagcacaatatgctcgtgaaaacaacgtaccttatttaggaatttgtttaggtatgcaagtggcgtttattgaatatgcacgtcatgttgccggactaaaaggtgcaaattcttccgaatttgaccgcacttgtgaatatccagtcattgcgttaattactgaatggcaagatgcagaaggtaatgtggaagtgcgttctgatgaaagcgatttaggtgggacaatgcggttaggtgcacagcaatgtcatttagttgcaggaagtttagcacatcaattatacggttcggatattattgaggagcgtcatcgtcatcgttatgaagtgaacaatgttattcgtccgcaagttgagaaagcaggactgaaagtaacaggcttaagtgcggataaaaaattggtagaaattatcgaagtaccaaatcatccttggtttgttgcttgtcaatttcatccggagtttacttcaacaccacgtgatggacatccgctatttgcaggctttgtaaaagccgcaagcgaaaaccggaaaaaataaacgtgcagaaaataaaaatagcttgggaaatccaagctatttttttcttattgatatagttccgacacaaattgaggagagagcaatctttctttttcatggaacaaggttcccatgtagtaagaaccgaacggagtgaaatgatcttgatcgccataaatagatttatttcctacataaactgtatcacctaaatattttgccgcatcaacccatgtaacattcggaatatctttaattagttggaaaatttcattgttgcttgcggtattgtccgccaatttttggatcggatttaaatatttatctaagtcatattttgctaagaatgcatttctaagagcggaacgatttaacgagatattattcgcaaacacatagactttttttgtttttgctagatgtttaaccatcgcttgaaatttttgatcaaaatcagcaattacaaaagaattaggattaaatctcggtacaggtgtaccgcctctttttaactcataaaacatggaaataaaaatgacaggataagattcaattttttgccagtattgcacacaatctttatcctcaaatgacaggcagtcactagtacgtaaaatatctgaacgccaaccttcttttgcaccgacataatttaaaaaatcttctagatgccctgcatgcgaatcacctatggttaaaattttacttggaatattgagaggcaatacttcttgttccgctttctgagcttgtaaagcagaagttttatgctttatatgagaacgtacacttaaattgtagccgatgacaactaatgatgggattaaatataataggaaaaaagactgtttaaaggttaatttagattttctaataggttgttccaataaataataacttaatgccgaacaaataaaagtgagtacgatgattgttgacatcctccccggcctaaaggcaggggattcctaccagctcccacagcaagctgtgggctactctcggtgggtttctactgctgatctctattgagattcacttcatagacgcttcgggtatgtcctaccctgatatttattatgcttggactattgcttgcccacgtgtgagaacattcattgctcccactacatcggcattttctgtatagccacattctacacattcaaaatgagcttgagtttcacggttttcttttgcaatatgcccacaacaagggcaagttcgactagtattctgtgctggaacagcaactaaaaatccgccaagccattgcgttttatagtccagttgtcgtctgaactcaaaccaagactgatctaatatcgcacggtttaaacctgatttctgtttcacgtttttaccgtgttcttccgctgtgccttttgccgatttggacatattcgcaacttgcaaatcttcaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacttacacgttcatttagttttcgtgactaaatatcgcagagaagcttttactaaacttattcttgatgacttaaaagcgatttttgaatccgtctgttcggattttgaagcaaaattagtagaatttgatggcgaagacgatcacgttcatttacttgttgaatatccaccgaaagtggctatatcaaaccttgtgaacagtttaaaaggcgtttcaagcagaatgattagaaagaaaaactatccgagtattcgcaaaaaattatgggggaatcagctttggtctccgtcttattttgcaggtagttgcggtggtgcacctatatctattattcaccaatacattgagcaacaacaaacacctgattagttaggtttgaaacggctacgccgtttgtgccttatatccacgccctaaaggacggggctttacggcactgtatggtaaaaaattgtccgcactttgtaaagtgatctaaatcacatttttttaaaatcattgaaataatcctgttatttgattgattttggtctgtagtgattgctgttaggctctttcgcatactcataaacgacaatagggcttttgtgaattgtgatagattgatatttatcaaaatctaatcctatctttctcaatcctttaaatatctgccctttgtgcgtaaactccgcaatattttcattgttgccgtctatggttttgcctgttaccacataaaaagcctttattctgcgttttggtttttgcatttaatcaggctcgctaattaattgataaagtgcaattccgccatgtggttgccctgtatggtctatgctattaattcttgtggtttcgatttgatagcctttctcacgtaactctttaattctctgtgcgggcgaggtaatccccatctgcctaaaatcaaaagtacttgagctacgctctctcaatacctttaaaatagttctgcactgtgtcgcttttgaattgtcttttagaactcctaccatactccccccttaacttgcgatatagctttcaatatcagctaaccgccaacgagtagaacgcccgcacttcttcgcctttggaaactcgcccttattcattagcttgtaaattgtggtagtagaaaagcctgtaatagcttttacttcttcgatattgataagtttcttttggtaaggttgaacagattgagcttgttcaatagtttggatagtttcgctttgtgttgtcataaattcccctttcggtttggtgttgtttgtgtgtggggaattgtgttggaaaataacttttatttcatcttattgatttttaaattaaaaactcgttttcaaataaagcttaattgaaaagaaaatccccttatttaaaaactaaaagggcttaattaaaaagattatttttgtttagaggggaatwtagaggggaatatagacaatccatttattcttaaattgtcatctattaaattgtctaaggttggatattttatatcgttagttctaattccatgctctttcatatccgcatttattgcgtcaaataatgcgtttctgctttgatagtcttgatagtttttaaacactagtagggaaaaaagatcgcgttgcggttggctaattcgtccttgctttggttgggttaaaacatcatcagatttaaccgcactttctgcccttttagcttgttctagctgtttttcaagttcggcaatgtgttcatctttcgcttgaatggttgaatttgcttgttcaagttcggcaatgtgggcatgtagttcggctatttgttgcaacatcactaatctttcagctaagcccacggggcttttatttatatctgtatttcttacaaattcttcagttcttgtgagtgccattcctaccgctagttttatctcattttgatatttattatttaaagcctctttatcaagagtgcttattcctaagatattttctatctgttttcggtcaatgaaaatattattttggtaatctgtcaaataatcttttgcggtgcaagtgtcatcaaaaattagtgcttgtttatcagttttaatctcttctaaaacagaaaaaaattcactaccgcaaatactctgaggtttgttactaatatcttctgttataatgtatgtttttattccatgctctgactcccaacattcaaatgcttcatccccccacaattcatcatctgtttttctaatatcgtgcggttcaagttttatcaataatagggttgcaatctcactataacatgcttgaggattgtgtttctttataaattctagaagttcagaaatggaaataaaatcttgctctctctgctttcttattgctataagctcgcttgtaacatcaaacatcttaaacgcccctattcgtttccctatctagtgagggtgccacaaggaatagatagggctattccctttcggctcggttaattactcctagcctagttgcaccaatttgaaaattcatgcttggttgttatatataaaacaatcctttcttcttgtctatttgtatttcttcggttgtgtttctattttactgtttatttttacagtcatcaactaagctaaacaatcgtaataaatgcgtcatgaatcatttaccgttacaaaactaggacaattcaaaacttaaaataggacaaaacgacttctaaataggacaaaataacctctaaataggacaaaacgacttctaaataggacagattttattattaatattttataagttattgtttttattatatatattatttttacgtcctatttgtcctattactttttctatcgcgtataaaaaaagcatttttaaggtaataatagacaataaaaagccttgctagataacaaggctattattcattgaattgattttagattattcagaaagtgataataatattccgcacttttcgcaataatccccccatgcttgatatgcttgctttctttcctctaggtaatcatatctatcatatatagcctgtattttccctttccctgttgaattgtgtgctattgccaactctccaacgacaacagaaaagccaatctgactaagataggatctaaatactaccctcaacccatgtgcgtcttgtttatctctatagccgttatcccttaacgcattacttacagtatctagtcctatggttttatttctgtttctcactctggggaataaataagggcttgagccgttaaattgcctaattgtgcctataagtttaatcatttgtgaggataaaggaattatatgatctttgggctgttctcttagctttctagtttgtttcatgttctccgaggggataataagcaacttattaccatcatcaataaaagcccattcaatgcgtgttagctctttctgtctcaaccctgtgagcaaagtcaggttaaatgcaaagagtgtattaaactctagcttaccctccttgaaagcggtgtttattgcctttaatagctccggtagctctgcaggtgtaatagctgggtgattttttgccagtggtgctataaaatcatcttttgctaaattgcaattatgcccctctataatgcctagcttaatgccataatctagagtagctttgacaagtctatgtaatttatcaagagtattgctagcccctatttctctgtaaacgtctattaataatctaggtgttatttctgaaagtggtatttctgcgagcttggggaatatatgcctttctaacctttgccaattcctcgctctagtgtcttcattgggtgcttttgttgggtatatttcagcataccatttagaacaaacatatttaaaagtgtttcgttctaatgcctgtgtgttttgtttttggtctctgtgtgttttaggatcgatattttgagcgagcagggctaaatactcgtctcttatctttcttgcttgtagtagtgatatttcaggatatttgccaatgctgatttctgtccgctttttagtataaggcttgtaatagttaaaacgccatatctttgaaccgctaatctctacagataaaaaaagcccgttgccgtctcttaatggataagccttttttttaatcttcgctttttctatttctgtatttgaaagaggtttgattaatcttgccataagtttagtagtataaaaaataaaaaaataaagtgctttgcaccctttaaaatcaaggctctagcggtttttagtagtataattttttagataaaaatgtattttatgattttatactaccatttatactactaaaattcattgctttaaacatataaatacgaataaacacaaaagaagaaaaacaataaaagcacgttaaagccagtatttacaagggtttatttaatgaatttgaaagagtgggaaagaatggaaaattgaagttggtgccagtggtcggactcgaaccgacacgcttttaagggcggcggattttgaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaattgtcgttttatcttgttctgagctatttctataatagcttaataaaatttcttcttctttagtaatgcttaatctttctctaattctcaataccccactattgagcaaaacattttttatatcagaaagtatttgatttagaaatttttcattttctttttgaatatcatctatcaattcctgtttcaatgccaaagtttccttagttactcctaaactagtttgtacagattctggcatatcatacacgtagtattcaaaaacattacctttcactccagagacacgccgtctacgccatttatcttttttagcatataagattataccttgtggtgttgaagggagccctcctacatctaaaagctctttaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgaatttacaatccaagtgcaacaaaaaaagaagtactcatcaactagaatataattttgtttccacacaaaaaccacttccaaatgatgagtacttcctaccgacatcttacaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagggttaaaagataatcgatacataattcctaaaggattatgtattactatgaaagattgtgttgaaagtacctttcagcaaagagttaagctgcttcttcaaagacctcgtttttatcagccagctgtgagatatttaatgcatctaacatatattgacaagcttcacgagctttaccagaagcccggacaatagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaataaacgttgaaagttattagctgcaataaagtaataactttgttctgtcgcttcaatttcggtaattatttcctgtttcagtaaaatatgagcaataccgttaaaaaattgatgcaataaaaatgatacaaagcctgctgtttcaacttttacaggtcgacaataaaagtacttgtcataccaaattttaatgtcatcttttaattgttgagagctcacaatttcatgtacaacagcagagatattaactaaattaccgttgtgattcagccaaatcgtataacgattccaanctcctttttgcaatggttctgtgcagatacaaaaaagatattggtaggcttgattatctagattacgattatcccagatgtatttcagtaaacctaaatcgtgtttcataatgtttctccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaagacgcttatcaaggcgtgatcagtggatggcaaaatggcattaagaaagtacctgcggtgttttttgataatctgcaatcctctcagagcgtgatttatggtatgactgatatacaaaaagcactagatgaatggcataaatgggttcaacaacacggtgaatcaaaatgaaaagagcgtttttttcggtacttctctctgtaagtttagcagtaccaacaaccttatatcctcaaccagccagagcctcattgaataccgcttccattgctgcatcaagtgcctcaacaagctgtttggaatataaagttgttggaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatctctcaagtcaaacttgaaatggatatgcaaaaaatgctcaccagtaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatcgaggtggttcaggtgtaggtggaaatttcccatcactcgcacaaatcagcggttcaacgatggatcaagcaacaggattactacgtaattttgaaggctttatctctaaggctcaatgggatgtaaatgctcatcgagtaggatatggttccgatacaattacccgagctgatggtacgatcgtaaaagtaaccaaagatacggtcattaccaaagaagatgcagagcgtgatttggcccgccgaacagctatcttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgtaagatttaaggggttttgcttaggatataaaatggatattacaacacaaaatattgaacttagatacttatctgagcagttttaccttgatgtcgctccacatctgaaagaaattttgcttaaagagactcgcccatactgtgttctattagttagagttaaaaatttagattttgccctaccattgcgttctaatttacctgaaagagaaggagttggaattaaaacgatacctaatcctcaggaatacggcaaawttaaaggaattgatttctcaaaagccattctactgacagataaaagctatttaaaaacagataccgttcagctcaaaaacaaatcagaattgttgaatatccaaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctattttgaattttctgacgtgccggtacatagcattgttgtacaaataagcgaacctctgtcaataatgctggattattgattttctcgtgttgaacttcaaaacgaacttgacgtaaatccggtttgcagggaattgaagctgttaaggcgtgtgttacccctttgttgatttgatgaaataatccccaccagatagggactctcgcttgttgatcacccaattcagagttcatttggttataaccactatcctctggtgcagttggaacacgataaccacaggctttagaacgttctacattcaactcaatattattcaggttgatcggtatcattggagctaagaccaatacaacgacaaacatcgccgggtaaaatttgaggctgagccaagtaataagtaaatcccctttattaccttcgtcctcaccttgttttttgacttccatccacgtactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtagatacagtaaattaagtccctcaataattgggatgacagataaaatcattaacctggcttttaatggcatttgcccttttcgattaagttgtaccatcaatagccaaatagctacatataaaacaaatcgccatcccaaccaggcatagcgggtttcatagaaccacgcttgaaaatttgtggaaggaaaataggtcattgccaaccagccaacaacgagtagtaataaaataataccgatgatcatcaaggttatttttaatacagtaataacccttgtcattttaggctttgttgtatcagacttcattattatctattacctcgttatacacagagttatccgcaattgatgtggataagggtaaaagattacttttcaaaccgagatactgagtaaggaatgccgaaaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaggatttttgtgggcctgcattaaataaacggtaatgttgtttattcattagtgtattcctcttgctttatcaatccgagctgcaacctctaaagctgcatcgagttcggtatagccgtgctgcatcatcagttgcttacgttctgcttttnnnnnnnnnnnnnnnnnnnnnnnnnnnnnnnnnnnnnnnnnnnnnnnnnnnnnnnnnnnnnnnnnnnnnttcgttgctaataccacgccctcggtatatttacgatctgattttttggcagataacaacatcgttttctgggcctctgacagtttccggaaacgattgatttcatcaatttcactggcagacacattcaacaattcccaccattcgaccattgagagtaatttcgccgcttcattcgggaagtcatccatattttgagtagcaagccatagccaaatyccwagtttncgccacatttttgagcctttmacyargaatttrgcwartarwgggttgrcagtaataatgtgagactcatcagtaatattgacaatagggcgaaaactgtgttggtatttttctccaagactgttgatatggttgattaaggaaatataggcaatggaaagctctgcttcatagccttcacgagcaaacatagctaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgagaatccttgggcagcagcacttgcagcagccaaaaagaaattcgttcccaaatattctggggcattggttttccgctctcctggaacacaagggatacccgaactatctgataaccagccaatctcttcgccattccctttattagaggtactcacaatacgtccatcattgaacacaaaagtcatactttttacactgcctctaacacaggatagtgtccagtcgccagtagcagtacctgatacaattgctccgtctacatcaggtaattcaataccattagcaatgagattttctcgaccaataagtactttgaacggataagcatccgatactcgattatcaatcgggatacgtccgatgagtcccgtcattgcaactgaatcaaggaatgttgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaactacatattcgtctaactgccagctaattaaaggtgttgcttctattgaataagccggtagcagcttggtaatttttttaggtagacgatgtgccacacgacgcacaccatctaaaggttcaactgtacgtagtggagcataaagtgattgtgctgcataacgggtcaatgcggcaggtactggaagctgaggacggctattcgcaataggcagatcagagctttcatcatctctattgcttgaaaaagattgtttttctaccgtaccgtcaaaaaccactcgaattgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagataaggtaacaaggacaacaatacctttccttaaagatgttgaaatagacatagtgcacctctatttttagttttacttcaggttaagagtgccaaaagcgatcctaaaatttaatggaaaactctgttaccgttcagaagagaaattgcacaaaatagtaaatggtgagaaagatattattctatgtttaagctagtcaattaagtagtatcaacaccgaaatcttcacgctttacgatgagataccagatgagatatctagcactgttccttgtagttttcccatatgttgcccattctcttccttcagcacagaaagtggggaatatttgccatgcagaaaatgctcaatataattacggaggtctttgggaattaagtttaagaggaaagttaatctgtaattattggcaatttctaggcgatgatgagcgaaaaaagatagagttacaattggatgagtacggggaatttcctatttggaatacctctgaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttccctgtcgttaatttttccaataacggcaacaatgaggcaacaattttatcgaaatannnnnnnnnnnnnnnnnnnnnnnnnnnnnnnnnnnnnnnnnnnnnnnnnnnnnnnnnnnnnnnnnnnnnnnnnnnnnnnatcacaaaaatcagcggacggtctttcattccgaaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcaatattttgtacaaaacgagaaatttgtgaataattcggacgctcacccatttcaaccaaagctcttgcgacaatattcacaaaacgccaagcaaattccttaaatgccgccgagttacccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttcaccatcaattttaatcattttgatattgatcaagcgacctttcaatgctacacctgtatcgcctttcttgtgatttttaccctctttttgataggtaaaagtatcaaaccaaaggtctgacattacaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaatagaaaggtgttccttttttcggctcaactaaacggatattgtttaaataacctaagccggttgtgtgaaggttaaaaaagtttttttgtgctgaagtttgagttgacatagtttgtttctccaaatgtaaaaaagcggagaaacatccttacccaatacgggaaaaatgtttcccgcaaggtggaagtaaaatggaatctcaatgaatattcactgaaatgatagggattgagttggcattcctgcaaatttacagagttccctttcagaatgctgggagacattttggcaataactcaactacctctaaggatagccgtcgcttctcaggagttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgacaacaccgttgataaatcacttaccaacggtgttgtacttttgaagaataaatgaaatttaagttagaccaatataagttactatattgaaaatagcagcaccttcgtgacaatgttgatattttcgttcgtaatttacccgattaccttgtggtctttaatcggcatatctgtggcatcatcgaggacacaaacggcaccctttattcacctgtgggctcaggctcagaatagttagcagtaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatttataactggcttcttaatttattcagttgatcgagtacatttaaattactacttttcttagcagatttatttgaagctgattttacctttttatcagcctctttatgttggcaatctggataaccagtacatccccagaatgttcccttagcgtgattgatttttctcattggcttaccacattctgaacattttcggatttcaatattcccaagtgacattccctgttgcatacaactgccgataagttgttttacaaatgcttcttgcttttgcataaatgcatcaagtgtcatactaccttcggcaatytgattkarkgcttgttcccataatgccgttaamccsggatttttcagtaagtccggcaaactatcaattaaggcaacggcttctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggataatcccatggtgagcggtaatttttttatcattccacgcccgacttttttgtcgcaaattnnnnnnnnnnnnnnnnnnnnnnnnnnnnnnnnnnnnnnnnnnnnnnnnnnnnnnnnnnnnnnnnnnnnnnnnnaattgtgattctggcagataaccacagtctgtacggggataagtcgtgattttatgctcttcgtaaagggattgtgcgatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcattttttgcaaaagtgcgtttaaaatctacttaaaactctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattatgatcgccgtaagatgatggttcaagaacagcctaaagatctcactttagccacaattcaggtgaaatcagaacctgttcagttacctgaaagcttaaggtccttgcctaactgggatgagccaaagcaggttcgccaaattcgctttagtgaaaaaatgatgaaccatacgaatatgccaatgatgaatcacggtacacatcacgctactacaacactaacggacaaccctattccaccaatgatgaatggtatgttcttaatcaacggtcaaacctttgatatgaaccgtattgattttgttaccaaattgaatgaagtggaacagtgggaaatcttcaatgaaagccatatggatcatccattccatttacacggcactcaatttgaagtaattcaacatacgttaaacggtaaaacctttaagccagaaggcagagcgttaaaagatgtggttaatttacgcccttatgaaaaagtgattattcgctttaagcaaggacatactgggttgaaaatgtaccattgccatattttagaacatgaaaatctcggtatgatggggatgtttaaagtggaatagtggtatctaactataaaaatagagggatttagtcataaaaaatctgyrccttaatcagttagtttttagtccaacttttggggtgcagatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaactgatgagcgttttcaggctggtttttttgccgagcgttcaaggataactttggtacacgctgtgcgtgccgtttttgcccagcagcagcacatcgtaggggtcttttcggccgccgtacgcttcaccgtccattcccggcgagccaatgggcattgcgggcacggcgatgccgacggcgtcggggcgttcggcaagcaggcgtttgacttctgatgcgggcgtgtgcccttcgacggcgtagccgtcaatcacggcggtgtggcaggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaccaaagtgtctactcgccgcaagttttcgatagcggcggcatcacggaacaatatgcccctgcctgccccgcgtcctgtggcgaccatcaccgacatcggcgtggccagtcccagtgcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacatgatgatggtgcttttgcaaaatagtttctgctaatgcatctaacaaagcgcgtttattttttacatgccaatacaatgtgggttgttccacacctattttttgcgccagcttacgcgttgttaatccttcaataccaacttcattaagtaaaatcaacgcattatcaataacttgttctttatctagctttgccattacctacctcaaaataaaatagccttgacaatctatcactgatagagatatattacnnnnnnnctatcactgatagatttttaggatctcaatgaataaatcaattattattatactgctgatcaccgtattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttcagcttgacgacgataaaacacaatccgatgccattccgttaattctcgacgttctccggtatttttatctgtccaactttcgctggttgctacactaatattggaaaccgcttcgccatttggcattgttctcacttctggatcgttgccaagattcccgacaataatcactttattaatccctgccatcgtatttactccttcaayraattaagttaggtttattaaacttgattcagcctaagaaaaaagtatttaattaaaatttggttagagtgaatttttcatttttacgtgtgcaatcacttattcctccgttgtaaaggctttttcttcgttaaggtaaggggcttgtccccttacctttaaaaggccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtcaaaatggctaaatagctgtttcagagaagtattcagcccagaatctttgactaattgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagcccattcgttttatcgcagcttgatagcgagcattcttttcttgatagtcccgacgagtgattcctgaactcttataacgctcaacgatcccaaaacatttccggattaaccttgcaccagcttcaatccaatcttgagcttctgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttctcgtaatactccttcgcctgctgaatccccaatgctttctcaataaaggttaaatctgcacgggtgtcattctcaattaaatgaccgatcagcaaatcaagttccgcttccacactatctgccgtctcacctttccaaggtttatannnnnnnnnnnnnnnnnnnnnnnnnnnnnnnnnnnnnnnnnnnnnnnnnnnnnnnnnnnnnnnnnnnnnngtattccctccgtctgcaataatataaaacggctcgcccgggcgttgggtaatattgggcttatgatctaatccgcgacgtcgaatggattcttttatcatctcaaagttaggattacgggttttgcgtggattatgctcataaggacgtaatttatccagtgttactgtaatatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagacttcatcacgatagataaacaaaatcacatcagcatcttgctcaagcgagcctgattcacgtaaatccgcattgacagggcgtttattggtacgttgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttgaatccgctacgtctaccaatttcgtcacactggcagtgtgctttattgctcgacattatacgtttataaacttaccttgcaagtggtaatttaatattttggtttatttgttttaattttcaacaaagttacctcaaccgcactttacaaaaatattttatagtaaagtgcggttgtttttttactctctttttctattaagaagccaccaaatgagaatcataaaaagtaggcttggaatgagggctgcaagtacaattggtatatcatacagaaggcttaatcgccctaaaatttcgttgataacataaaatagaaacccaaaaaaaatacctgttacaatccttgctcctgcagtaacactgcgtaaagatccgaaaataaaagaaagtgccaacaacatcatcaccgcaacagagaccggttgaaagactttttgccaaaaagtaagttcaaaacgtttagcatcttgtcccgtttctttcatgaatttaatatagttgtataatccggtcatagacaacgacgttggacgcaaagaagctatccccagcttatcgggtgttaacgttgtactccaattatctttcaagcgattaatcgttttaatttcatcagcaaaaatttgtgattgattaattccgcttaatttccatttgccatgttcaaaacttgcttggttcgcatatgtaacttgtttcaattgacgcttatcatcaaaactataaatataaatatcattcaacctaatatcattagtaatacgaccaacatagataaaatcattaccatcttttgcccaaatactattttttactgaaagcatggagcctccggaaattgcttttgcacgcatatctctggcaaaatgttccgtctgcggaattccccattcgccaatgatcattgtaataagcaccagtggcagtgcggttttcatcacagctaaaccgattctaaaacgagaaaatcctgcagattgcatcacaataagttcactacgacttgcaaggttaccaagtgcaataagtgatcctaataatgcggccataggaaaaaatgtttctatatcttttggcatagttaataaagtaaacagtgttgcctgaataacatcgtaagttccttttccaatactacgaaattgttcaacaaatttaataatcgctgataaacccaccaacatcagcaatgtcgccaaaatagcacctaaaatattttttccaatatagcggtctaaggtattcatcatcattattcctgattaccttttacttgaattaaagttaaataaataacgtattttatacataaaaacactattccaactgttcaataaaacagctaaaaataaaaagaaaatactgactaacggcataaaaatatgtgcttcaattttaccggaagcccccgctgattttaatgaactttgtaacaagaaataaattaaatacaataaaagtgcgggcaaaatcttagcaaaccgcccttgtctcggattgactcggctgagcggtactgcaataagtgccataatcggaacagcaaaaattaaggtcaaacgccaatgcaattccgccttagctgcaggtgatttagaattaattaattcctttaggcttaaaatttccgtttcagatgtatccttatctgttgtcttataatctaaataggcttgatactggtcaaaatgcgtgatacgaaagtcaggtaaaagtgcgcttccttcaactcgctgactattttctagactaagaacttgatcgccattgggtaacaccttcaactgaccggtttcagctaccgttacggaaggcttctgattttttttattttccatttggaaaacataaatatcttgaatttgattgttttttatttcattgataaatagcacaacatcagtatttccgacattaacaaattgtcccgacgctaaagcccccattgttggatttgcttttgcatcatcaataagttgaatttgtttttgcattgcccaaggggatagataaaacacattataggttgccaatcctgctgtcaataaagataaaattaacgcaacaccaacaagaatacgctgaccaacaccacaagcccgcatgacggtaatttcgctttctgcatataaacgtccaaatgtcagcaatatagcaataaataagcaaaggggaaatataagttgtgccatcgtcggcatacccaagctaagcaaagcaaaaaccaaatcagccggaattttaccaacagatgcagaacctaatacacgcacaagttgttgactaaaaaaaagcagtaaaagaatagataagattgcaatttggcttctaaaaacttctttggttaaatatcgaattaatatcactgaattacctatatttctcttgcaattttaaaaaaaagcagtaatttacgaaatcacatacatggcgatgtatgataacgtatttttttattgaaaacagtaaattcgtgaggattacatgaaatatagtgcaaaaaataccgcactttctcaaattgacagcaacattattttagccgtatttgaggacggagaactttctccgacagcaatgcaatttgaccaactcagtcaaggctacctaactcgcttaattcaagttggtgaggttagcggaaaacagggacaagttctgattttacgggatataccgaattgccaagcacaacgtatttttatcgtagggtgcggtaaaaaagataaaataacagaacgtcaatataaacagattattcaaaaaacaattcaaacgattcttgagactcaagcaagtgaagttgtgagctttctaaatgaaattgaactaaaaaatcgtgatattcattggaatattcgttttgcaattgaaactattgaagcaagtttttatcaatttgatgctttcaaaactaaaaaaggcgacgaaaattcagtattaaatgaatttatttttgatgttccaaccgaattacaacaagatgcattactggcgattacttacgcacaagctattgcattaggagtcaaatatgcaaaagatattgccaattgcccgcctaatgtttgcaacccaacttatcttgccgaacaagcacaatctctcgctaaacactcaaacttgattaacgtgcaagttttgggtgaaaaagaaatggcagaattgaacatgttctcgtatttagctgtttcgcaaggaagtgctaacgaagcaaaaatgtcggtgattgaatatcgtaatcaccccgataaaaatgccaaacctattgttttagttggaaaaggtttaacctttgatgccggcggtatttcattaaaacccgctgatagtatggatgaaatgaaatatgatatgtgcggtgcagcttctgtattcggtgttatgtacgctctagcaacattacaattacccttaaatgtaattggtgtattggctggttgtgagaatttgccggacggaaattcatatcgaccgggagatattttaaccactatgtcaggattaaccgtcgaagttttaaatactgatgcggaaggacgtttagttttatgtgacgcactcacttatgttgagcggtttaaccctgagttggtcattgatgtagcaacactaacaggtgcttgtgtagtggcattaggtcaacataacagtggcttaatcgcaacagatgaaaaacttgctgaaaaattattaaatgcggcagaagaaacgaccgataaagcttggcgtttacctttaagcgaagagtatcaggaacagttaaaatctaattttgctgatttagctaatattggtggacgttggggtggagccattaccgctggtgcatttttagctaactttacgaaaaattatccttgggctcatttagatattgcaggaactgcctggttacaaggtacaaacaaaggtgcaacgggacgaccggtaagtttactgacacaattcttaattaatcaatccaaataactgtaaaagtgagagtttctcttttagaaaatgactgccaaatttcaatctaaacaaaaggagactctcgttttttattcaaccaatccattgggcagaaatttcccccgcacttaccttctatctatcactatcattgcttaactaatacagctaatccggcattttgttaaatgttgatccataaaatttcagcataaaagatgattttataaataaaatgagctaaagtagccgagttttgtaacaaagatgatttttaaggatatgtcatgaaacagtccctacgtcataaaaaaataattgagttaataaagcaaaaaggttatttaagtacggaggagttggttaattttcttagcgtcagtccccaaaccattaggcgagatttaaatgaactggcggaaaataatctgattacacgtcatcacggtggagctacttcactttcaacatcagagaacagtgattatagtgaacgtcaacatttcttctcgtctgaaaaacggcgtattggtcaagaggtggcaaaaattattcctaacggttcatctttattcattgatattggtacaacaccggaagctgttgctaaagcattattggatcatcaaaacttaagaattgttacaaataatcttaacgcagcctatattttgatgcaaaacaaaacatttgatattacgatggctagcggatctttgcgtcaagatggaggtattattggtgaagcgacaattgcatttatcggacaattccgtttggatttcggaatattaggcatcagcagtattgatttggacggttctttattggattacgattatcatgaagtgcaagtaaaacgtgcaattatggaaagctcaagaaatactattttagtaacagatcattccaaatttactcgccgagcaatggtatatttaggttcgttaacagaagtagactatttgtttacaaacaccacaccacctgactccatgcttagccttattcattcaagcaatgtaaaactgcatatttgtcaatagaatttttatcaatagagatgtgtagaagattttatcttctacacaataatcaatttaatgccctcgccaataaactgacagggtgtaaacaagaagcacttgttgacatatcaatttgccatttgcaagtttcacattcagtgatgacataatcgaaacaaccttgttcaataacctcaaataaactttttccgatggcctgtgaagtctgatagttttcagatttaaagccatatgttccagcaataccgcaacattgagacggtaaaatagtaacatcaagatccggtatttgtttaagcaatgccaacgtataaggtgcccaccccgctttttctacatggcaggcggtatgataggcaactttaagaggtgtagacttaaagtgcggtatttttccatcaagatatagtcggtaaagatatttggttgcaatattgacatgaggacgaattctcgcattatccatccccaaaatatgatgatattcatcacgtaagttcattgtacaacttgaagatgtaccaataatatccaatgctttttcttgaatcacccgttcaatttgtttgatgttaaactctgcttgttttttagccttttcaggaaaaccgttcaccatgagcggcaaaccgcaacatttttctttttcaagcaaaatcacgccaatatcaatcgaattaagtactttaatgagatctttaccaagttgaggataattataatttacataacaaccgtgataatacactatcttatcccgaaaatagatctgacggtcaagagcatattttttataccattgacggaacgaaccgaatgaatattttggtaaagtgcggtgcttactgaccttaagggttttatctaaaacatatcgggttgcttttaatccagtaatcgcatttacaattggagcaaaaggcgtattcattttacccatgatatccgtattacttaatacagcatcacgtaatttatgtattggtgatttatgttgttggtcaagatatttatttctagcacgaatgataatatcaccaattttaacgtctgacggacaagcaacctcacaacgtttacaattgatacaatattttaatgcttcatcataaagtgcggcactttttaagcgtaaccgttcaccgtccggtcccgcctgtttaggtccgggatagaaaggattttgacgagaaacagggcaaaccacagtacaagcagtacattttatacagctctcaaaactttcatcggtatggtgctgagtaataggaaaagcagcatgttgttttgcattttcaatgagttgttgaatattcatattttgccccttatactcgattttgtgcttcgataatgctatcggcagctgttagtgcagtaacaactgccactccggaaccacaccctagttccaatgcattgtatccgccaataacatttccagcagcatataaatttttaataatctgaccgctcttttttaattggcaacggctgttaattgcaacgcccgcagactgataaggctgaggtgaagaaaaacgccgagcagtccaagtgagtctgttttgtatatcaatcattgaattgccaatcatgtccacatcaaatataggttcaagtaaacgatcaaaaacactcaccaaaccattactgaaaaaactaccggaagcaagaacaaaatgttctgcgaaaataccatgttcttgatgtaattgagtgtaaatttgtttaacctgttgatcctcaataacggcacgcaatgctttatcaccatttaaaataaaaccgcccagtttttcaaaatacgtttttaattttttatgttgacgcaatcccactaatgaaggtggtaatgtaggcaattcgtataaatttaatccagtttccaacgttaatttattgaaaaaatcttgattatccaaaccgaaacaagccggtaaaaaaattgcttccccatctccggacgcttgctttatttcttgtaccaattcacgaaatgccaaacggtgttcaagtaattgagaaatattgacactgcgaaactcacgagaagttaaacgcaattgatccaactcaggaagatgtaaaagtgcggttgttattgaacaatgtttaaattgcggatgttgtattaaattttcagccaataagtgcggttgaaaatcatgataaccttcaattcccaatacagtaattttttggtatccgaaatgttcatcatgaagatccattgttggaatacaatcagcggacagccaagtgcggtgcaatccgcccaacggtgtaacacgaaaatgattttgcttatagcttcccgtcacattgagattaattttttctattaattgttcaaattgcttggctttttgtaaaacatgttgtttaccaaataaacagtacggatgatttggaagttgttcttcaaggctgtcataaccttgttcaaaagaatttatcttttcaccgtttggtaattggcttaaaagatccattgaacctgatgaaaaattcatggctgattgaccattattaataatcgcacaacatttccctttttgttgaagcataattccgcaagttaaccccgcaagcccgcctccgataatcactacatcaaatttcattgccatctgttccttgctgtgcttgttcagttaaagattgaacactatttaagcctaataaactgtaatatatccaactggaaaattccgcttcacggattgcttcgccccaagcaatcggttcaatacctcgccaacgttcttccataaaagatgataattgcagtgtagattgtctaggtgttgccatatgaaaacgtgccattaatcctgccgcacggcaagcacaaagttcagcctggcaagttcccatgcccacacgtgtacgacgacgtaaatcaacaagattattgacttttaattcttctacagcataacgtacttcaccggcagtcaccgcttcacattcacaaacaagtgtacaatctgaccgctcttttccaatcaaacgagaagcccgttgcccatgacgataacgtgcggaaatttgaagaggtgttggtaacgatatgattttattaatatgaggaacattttgatcagattcagaacctggaagtaattcttgggcagttgtacaaacagtttgtttgccaagttttttactaactaaatcagttgcccattccgccatcaaacgataagtcattaacttacctcccgtaatagtgacaaaaccttcaagaccatcacggcttgcatggtcaagcaatacaataccacgactaacattacgtcctgatggatcatcatcactcgctaccagaggacgaacacctgcataggcacgaagtactctagtatgacgtaaactcggtgcaagtttttcgccttctctaaataaaatatccacctcttcgggagtaacaatcatgttatcaatttgatcataagggatacgatctgatgtggtaccgataacacagatagtatcgccaggaactaaaatatccgcatcagctggtttgcgacatcgattaattaccaaattattaatgcggtgccccatgacaagtaatgcacctttagcaggaaacatcttgactttgagatcggcatattcagcaatcccctgtccccaaattcctcccgcattaacaataacctgagcaaaaaaacggcgatttattttatttttgtgatcatatacttctgtaccaatcactcttccgccttcacgaatcagttgagtaactgcacaataggtaaaaattttagctccatgctcacgtgcatccaacatattggcagaggttaaacgaaacggatcaattgaaccatcgggaacaacaaccgcacctataagctccgggtttactgaaggctccattattctggcaaggtcaggctcaatcggtactgcttcaatacctgcttttgtacaggattgaataaatatcttttgataattaagatcgtcttcaggtaacgtaatgaaaagccctttggtatcttcaacacaatgacgtgcaatacgttttaagatcttattttctaagatacattcctctgccgattcatgatcattaacagcgtatcttgcaccgctatgcaataaaccatgattacgtcctgttgcacctgtggcaatgtcataacgctctaataatatgcagtcaatcccacgtagtgcacagtctcgtgcaataccggctcctgttgccccaccgccgataataatgacatcagcactgagcggtggaaaatctttagaaaatttttgagacgacattgacataatcatcccccacattgaatgtaaaaaattactattagaaagtgattatataatacgttaaatgttcgttttagaaaataaaatgcgtgatttcttatcaaataatgtgattaagatcactttattagtttcgatttgaattttttttgtgtttttttgtgatttacatcacaacataaattaaattagctttttagatttcactttttggttattatatgagtgaacgttcaaaaaagtgcatttatcgctcctaattttttatacataagattggtttgataattgctatattttaatctaactaaactactggagatttattatgtttggtccatttaagcccgcaccgtatattgaggagctatcaaaagatagaatcgatccaacttatagacggttgcgttggcaagtattcatgggaatatttttcggttatgcggcttattatttcgttcgtgctaactttgacctagctcaaaaagggttaattgaagccggtttatacaataaagcggagttgggaattatcggtacgggagcaggtttggcatatggattgtcaaaatttgtgatggcaggtatatctgatcgctcaaatccgaaagttttcttgcctttcggtttattattgtcagggttatgtatgacaatgatgggcttaatgccttgggcaacctccggtattgctgttatgtttgtgatgatattcttaaatggctggtttcagggaatgggatggcctccatgtggtcgtacaatggttcactggtggtctaaatccgaacgtggaacaatcgtttctatttggaactgtgcacataatatcggaggtatggtaccgggattaatggtattgttggcaagtgcgatttatttcagcgagtttggagtacaggcaactgcaaaagatatttggcaacaagccttatattatccaggtattgccgctatgatttgtgcaattccggtctattttgtgatgaaagatacaccacaatcttgcggattacctgcaattgaaaaatggcgtaatgattatcctgatgactataatgaaaaaacctatgaaaacaatttaacaacaaaagagatctttgttacttatgttctaaaaaacaaattgttgtggtatatcgctattgcaaacgtatttgtgtacctcattcgttatggagtgttgaaatggtcccctgtatatttaggagaagtaaaacattttaatattaagggtactgcttgggcatacactatttatgaattagctgcggtaccgggtacattattatgtggttgggtttccgacaaagtatttaaaggtaaacgtggtttaaccggtttcattttcatgattttaactactattgcagtggtagcattatggatgaaccctgcaacaccagaacatgaattagcacagtatgcaggaaaagcgtggtatcaaaatccatatcaattaactgacttcattttaatgacaacagttgggttcttaatttacggaccggtaatgttgatcggattacatgcacttgaacttgcaccgaaaaaagcagcaggcacatcagcaggtttcacagggttattcggttatctcggtggtacagtatccgcttcagccgttgtaggttgggctgcagaatactacggctgggacggtggcttctacgtcatgataaccggtggtattttagccatcctgttaatgtttatcaccatgatagaagaaggtaaacataaagcaaaactagacgatcattacggtaaataatcgttaaaaaggaaagacaggaaactgtccttcctttttctttattaggtttatgtattcaaattttaaccacatttttatcacagattttacttctacttaaggaaaatacaatgaaattagctacccctctttgtgcaattgctttagtagctgcaacactatcaggttgttctgcacaatttgaaaacaacgttaaccaaaaagataaaattatcattgctcaccgtggagcaagcggttatttacctgagcatacgttagaaagtaaagcacttgcttttggccaacacgctgattatctagaacaagatcttgcaatgaccaaagataatcatctcatcgtcattcatgatcattttttagatggtttaacagatgtggcgaaaaagtttccacatcgtcatagaaaagatggacgttattatgtagtagattttacgctgaaagaaattcaatcattagaaatgacggaaaattttagtctgaaagacggaaaacaggttcaggtttacccaaatagattcccgctttggcaatctcatttccgtattcatacttttgaagatgaattagaatttattcaaggtcttgaaaaatcaactggtcaaaaaatcggtatctatcccgaaattaaagcaccttggctacatcaccaagaaggtaaagatattgctttagcaacattaaaagttttgaaaaaatacggttatacgaaaaaagatgacttagtctatttacaaacttttgattttaatgagctaaaacgaattaaaacagaattgttgcctaaactaggcatggacgtaaaacttgttcaattagtggcttattctgattggggtgaaacacaagaaaaaaatgctcaaggcaagtgggttaattacgattatgattggatgtttaaaccggatgcggtagaaaaaattgcaaaatatgctgatggtataggccctggctggcacatgatgatcgatcaagaaaaatctaaaccgaatgccgtcgcttatactccattagcagaagaattggcaaaatataaattagaggtacatccttataccgttcgcaaagatgctttacctgacttttttgataatgtagatcaaatgtatgatgctctatttaaaggcggtgcaacgggagtatttactgatttccctgatacaggtgtaaattacttaaaaacccataaataattcgacattaatatctgtcattcttttaaacgaatgacagatttttgttcttgttgtaaatagccatttctccattatcctagcctttcaacctcaaccttcccctacgatatttcgtgcgtaaaagtgcggttattttatccggtgtttttattgcaatagaattagcaatctgtaatgagttatgaatagaatttgcatgggtaatggcaattgccaacgcatctgctgcatcaacctgcggtttatcggaaagttgtaataaccgaaccaccatttcctgtacttgtgatttttcagccgcacctgttccaacgaccgtttgtttaatcgttctaggtgaatattcaaatacgggtaaattttgattgactgcggcaactatcgctgttcctcttgcttgccccaattttagagcagaatcaggatttttcgccataaaaacctgttcaatagcaaattcattgggattgaattgcgtaataatttctgttattccggcataaattcgttttaatctagttggtaaatcatctattgaggtacgaataacaccactgcccaaatattctagcttatgcccaacttgacgaacaacaccatatccggttactcgagatcccggatctattcctaaaataatagacatcctattttccaaaaaataaatgaacctcatttgagatccatttaatatagactaaaaattattttgcaagtttaagagattgagctgatgaaacgtttttcatcatgcctctcaactaatttcataaatgttcccgatagaaaaaatgaagctaacttttaaagtaaagcagcaacctcatcacttatctcgccattatgataaacgttttgtacatcatcacaatcttccagcatatcgatcagtcttaacaatttaggtgcggtttctgcatccaaatcaaccattgtggaaggtatcattgttacttcagcattaacaactttaaatccggctacttcaataccgtctttcactaagcctaaatcttcccatgctgtgtaaatttcaacactaccgtcttcttgtacttgaatatcatcagcacccgcttcaatggctgcctctgtcaaggcatcctcgtcagcagactcaactaaaattagcccttttttactaaataaataccctactgagccttctgttcccaaattaccaccgcactttgtaaaacttggtcgtacttgagaaatggtgcggttagcattatcgctgagacactcaaccatcaccgcagtcccgcccggaccatagccctcataaattctagtttccatattggtgccatcaccaccgccgacaccacgctcaatagcacggttgatagtatctcgtgtcatattgttagataaagctttatctactgcggcacgtaaacgagggttagcaccaacatctccgccacctaattttgccgctgttactaattcacgaattaatttagtaaaaattttaccacgttgtgcatcttgtgctgctttacgatgtttaatattggcccacttactatgtcctgccattttatattccttttatgattgtacttttatattcattaatcgcctctgcattgttgggcgatttagtcaatttaattgcgtcctgtaccgaacaccattgataagctgaatgttcacttaaatttattactctttcatcagctaacggcaacaaaaaccaatgctcaatgcagtgagttatatcaggcgcatatttatacctaaaatgcggaaaaatttcaaactctatctgtttatggcaattaaagagcggtaagttttccgcaagaatatctatgcctgtttcttccctcacttctcggattgctgtttgaacaggtgtttcacctatttccatcgtaccggttacggattgccaaaattccgaatcgtcttgacgttgcagcattaaaatacggttggttttcttggcataaataacgaccaaaatactgttgggatttttatagttcatttggattaccttcttaacgtcatcatcactcacattaaccaaaataatgttaaatgaaaaaacaacaattgatctgccccaaaatctcttaataaatcaaaatattaaaacatcattaataattaagatagcatttcaaatttcgtatcattgctacatagtaccgacttttttagcaaatttttctacctttttcttttcttctaattctttttgttgttgctctgcacgtttacgacgaatttctttcggatccgccaataatgggcgataaatttcaatacgatcaccttcattcactatatccgttaattttgccgggcgactgaaaatgccgactttattttcacgtaaatcaatttccgtaaattcctgcaaaataccagattggaaaatggccgcttgaatgattgtccccttctcaacttgaagttttttcaaataatatttatgcggtaacgcataagtaatttctatattaatcaagataaacgtcctttgctcgttgtttaaacgcttcgatcattttcgttgtcaattgtgaaaaaatccgcccgaaagcaaaagcaataacagggttggaaaattcaaactccaattgcaacgcaatttcacaactttgctcatcaatttcacgaaaaacccatttaccctgcagatatttgaaaggtccggaagctaactgcatcgtaatctcttggttgggaattaattgatttttagtcgcaaaaacctgtttgataccggctgtactaatggttaattctccgatcgtttcattgtctatcgactgcaatgcttttgccgcaatgcaatggggtaaaaattgtggataactttcgtaatcattaacaatatcgtacatttgtttagcactataagacactaaagctcgctgatttatacttggcataaaataagatgttgaacaaaaaatgttgcaattatagcggaaaagtgcggtagaaataagagacaaaatagaaaagaatgattcatacaacaagcagttaatgtcgttgctttctaattgagcatacatcaattttccgctacaatagcccactatttttagcgaacaaaaataccaatgtcagaaattaaattaattgtaggtttaggcaatccgggcgataaatacgccgatactcgtcataatgcaggagaatggttaattgaacgtttagcaagacgctttaacttcaatctctctgttgaatccaaattttcaggaaaaacggcaagagcggtcattagtggtcaagaaatgcgttttcttgttcctaccacttttatgaatttaagtggcaaagcagtaagtgctttagctaatttttatcgtattccgccggaacaaattttagtgcttcatgatgaattggatttttccccgggcatcgctaaaattaagcaaggcggaggacatggcggacataacggtttgaaagatattattgctcaactggcaaataataaaaatttctatcgattgcgtataggaattggtcatccgggtgataaaaatttagttgcgtcttacgttcttaataagccatctcccacagatcggcaattaattgaccgctctttagaggaggcgacggattgtattgaaatcctcatgaaagagggaataactaaagcaacaaatagactgaatgcttttaaagcataaacaaaattcaccaatctttgggctgaaataactcttctactctactaataaaaaataggaaaatttatgggatttaaatgtggtattgtcggtttacctaatgtaggaaaatccactcttttcaatgcgttaactaaagcaggtatcgaagcggcaaactatccgttttgtactattgaaccgaatacgggcgttgtaccgatgcccgatcctcgtcttgatgcactggcagacattgttaagcctgagcgtatactaccgaccacaatggaatttgtggacattgcgggattagttgccggtgccagtaaaggtgaaggtttagggaataaattcttggcaaatattcgggaaacggatgctattggtcatgttgtgcgttgttttgagaacgatgatattgttcatgttgccggtaaaattgatccgttagatgatattgaaacaattaatactgaattagctttagcagacttagatagctgtgaacgagctattcaacgcttgcaaaaacgtgcaaaaggtggcgataaagaggcaaaatttgagttgtcggtcatggaaaaaattctacctgtactggaaaatgcaggtatgattcgttctttggatttagataaagacgaattacatgccattaaaagctacaacttcttaactttaaagccaactatgtatattgctaatgtgaatgaagatggctttgaaaataatccatatctcgacaaagtgcgtgagtttgctacaaaagaaggttctgttgtggtaccagtttgtgctgcaattgaagcggaaattgctgaattggatgatgatgaaaaaactgattttttacaagatctcggtattgaagaacccggtttaaatcgtgttattcgtgcaggctatgcgttattaaatttacaaacctacttcaccgccggtgtaaaagaagtgcgagcttggacagtttccgtcggtgcaacggcacccaaagcggcagccgttattcatacagattttgaaaaaggctttattcgagcagaagtcatcgcttatgatgattttattcaatataagggcgaggcaggtgcaaaagaagccggtaaatggcgtttggaaggtaaagattatattgtgcaagatggcgacgtaatgcacttccgttttaatgtttaatattcataactaattttataccgcatttttcgatttgaataataaaagtgcggtattttttagagagaaagatgaaatatcactttatttcccggtgttccattaaagtttttaactgggagacgtttgttgatgttgaagatttagcagatgatcctgcgagaatacaataaccgaatgaatgatctttagtgtggcttgtgtcataataggcatcgttttttcagcgacttagaggagaatgattacatgagaattttacatactatgttacgtgtgggcgatatggatcgctcgatccacttttatcaacaggtattaggcatgcgtttattgcgtacaagcgaaaacactgaatataaatattctttagcttttttaggctatgatgatgaagaaaactcatctgttattgagctaacttataactggggtgtaagtaaatatgaaatggggactgcttatggtcacattgctattggagttgaagatatttatgccacttgtaaagcggttaaagaagcaggtgggaaaattactcgtgagcctggtccagtaaaaggcggaaaaactgtcatcgcatttgtggaagatcctgatggctataaaattgagtttattgaaaataaaatggcacaagcagggctaggtaatcaataacctcaacaatttttatcctaaaaaatgggctttttatctgtctattttaagtattacatttatctcattcttataaggcaatatttcgtgaccgcactttcagaacaagcagtggattataatttacttaaaaatcgctttcggggtttttttcctgtcattattgatgtggagacagcaggctttaatgctcaaacagatgccttgctggagttagctgcaatcacactgaaaatggatgaaaaaggtctattagtaccagatgaaaaatgccattttcatattcaaccgttcgaaggggctaatattaatcctgaatcactcaaatttaatggtattgatatagacaatccgttgcgtggtgctatatcagaaaatgttgctatgagtgaattgtttaaaatggtgcgtcatgggcaaaaaaaggctgactgtcaacgttcagttatcgtggctcataatgcgacatttgatcaaagttttgttatggcagcagcagaacgtacgaaaataaaacgcaatccgtttcatcctttttcgatatttgataccgcaacgttaagcggttttatgttcggacaaacagtgttggtcaaaggttgtcaggttgccaatatttcttttgatggaaaaaaagcacattctgctttatatgatgcggaacgaacagctgaacttttttgttatatggtaaatcatttaaaaaaactgggcggttttccccatgtggcaataaactcataaaaaacggtgctaacaaagcaccgctcttttgcgttactccttattcaaattactgtacaacaatactccctaaacaaccttgatcagctaacactaaatcagatgaaccgaaaataaaagggaatttagtagaggacgcatgattaaattgcactaaaatttctaccttgccgtcaatccaaagactatctttccatgcaatatccgattgttctaccggctgatcatttatgcttttcatgacaaaacgagcaccttgaattttaaatccgacgggccttgaagaacttagaatccagcgttctatctgccctcttttggtactaatgtctattctattcggttcaaaccgttgttgattaatggttgcattgctcacatcaaaataaaactctctcgttttcatatttttctttgccaataaactaggtgcatcagtatgaaattgccaatgacttggattataaaatactgatttaaccccctctgttcttaactcaacaataacattatcaaccagcatatcagaactgaatattgtacctatcttattcaaaagatttcttttactaccggtaattaaggtagcatttccgccctcacttaagtcaaccaataattcaaccctttcactaggtgcaagagaaacttttttgacaatttttgtttgtggcaaataaccttgttctctggcaatcaagaaaaatgcccgctcatcatcaaatgttaaatcataagaacgagataaagaggcattcaacaaacgtaaacgtaccaatcctttaggtacattcaaataaggtgcttcaacaccattgaccaataaccgctcgcctagaaagtgcggttgattttgaaatacttgctctcccttagaatttaacagtacatcttgcaaaataagtggaatatcatcaacgccatatttttttggcagtttagattgatgagtatctttgtcatttataatccacataccaaccaagccacgatacgtttgatacgctgaattagctaaagtgcaggcatgataaaaacaagttgatgccggttgagtaataggtaaaattggagcccatccttcccctgccttcaatactcgcccaataccaccaattaattcactgtgtgcttgtaaaccttgtatattcatagcaactgcctgcgttaaattattacgataatttaacttcacaaaatcaccttgctcaactcttacggtaggacctaaatgatgcccattaaatccccaaacttccgttagctttttttctatgaatgaagtttgagcagcttgcatcattaaaaatatcggtcgcccacgttttgcctccaataacggtggaataaataaaggcaaacggctagcagccattactgattgagggatacatgataaagaactggctaaaataccgcttttcaaaaaatcccgtcgagtcaaagatctcatattttaccttgctgcttatacagattgctgttgaatttctgcatcaagctctgcgatgcgttgttgcataatttgatgacaatattcagctaattcccgtacattatcctttgtgtagtttgatgtatctacaggagacatcatttcacaaatcactttaccattgtcccaccgatttaggtcaatgcgattatgggtggttgaacaaacgaccggaacaattggcacaccagcggtaattgccgcataaaaagcccccattttaaaaggtaataatccacgcccacgactacgtgtcccctcaggaaacatccaaactgacaaattatcttcatttatacgatgagcaagttggtttattgtattatgggctttggagcgattttctctgtctaacaaaatatttcccgttgcccaataaagaagaccaaaaaagggaatccaaaccaaacttttcttgcctacactgactgtacgagggcgaaccatagcagaaacagtcaccatatcataattattttggtgattaccaatatagatgcacctaccgatactatcgacattttcaggaaaacgatgttcaacttttaatccaaaaaaaggatataaatgcccaaaccagcgagccatcacacctacattacttggatttttaaaacgaataagtgaataaagagatcctactacacaaattaaaatactacagaagataacaacgatggctcttaataatatcaacataaatatacccctaaaaatttgtatacgccaagtataacgaaaatctaaaaataagtgtagaaaagcataaaaaagtgctaggctagcacaaatattttaggaacctcagcatgaaaaaaacattctttattgcagatttacatttaagcgaaaaccgaccgcatttaactgaactctttgttcattttatgcaaacgcaagcactacaagcagaaaagctttatattttaggcgacttatttgatttttggattggtgatgatgaacaatcagccttgatcgaaacagttcaacaacaaatattacagctcagccaaaaaggtattccttgttattttattcatggaaaccgtgattttttggtgggaagacattttgccaacagttgcggaatggagttattaccaacctatcagatcgttaatttatatggtaaaaaagtacttatttgccatggtgatacgctatgtactgacgatcttgattaccaacaatatcgcaaaaaagtacaacaaaaatggctgcaatggctatttcttcacttacctttaaaagtgcggttaaaaattgcagaaaaaattcgccaaaaaagcaaaacggataaaacacataaaagtattgaaataatggacgtcaacaaggattttgtagaacagattatgcaacagtttcaggtcaacattttgattcatggacatacgcacaagcagaatattcatcaaaatccaccgcactttactcgcatagttttaggtgattggggagcaacagcttctgttttagaggtttcagccaatgggtttcagtttatctaattcgtcaggcacaaaacctaaacataaagaaaaagagatcaaaatatgccctttttccatcacaactaaattttttccaatttggctaaatgagcgactagccatttaatcccttgtccctgaaaagcgatttgcaatcgggtattattatcagccccctcaacattaatcactgttccctgaccaaatttttcatgtttcaccttttgtccaactttccaactattatccgataaatcagttttgacgatagaacccactgcacttcggttataagctcgagtcactgtgccacgtaaacgaacttcttgaatacattcttgcggtaattcagcaataaaacgagaaggaatatgtttttcgtctttaccatacaagcggcgaacttccgcataacacaatgtcaatttctgttttgctcgagtaatccctacataagctaaacggcgttcctcctccaaacgtgccaagtcttcacccgaacgaaaacttgggaaaagcccctcttccataccaacaataaatactcttggaaattctaagcctttcgctgaatgcaatgtcatcatttgcacacaaggctggtgagagtctgcttgttcttctcctgcttccaaagaggcatgtgttaaaaacgccactaaatcagacatatcttcagcctcatccggttttataaattctctcgttgcggtaaccaactcctccaaattttcaattcgcacttcccctttgtcccccttttcctgtttatacatgtcatataaaccggaatgtttaatcacaaaatcagtttgtacaaataggggcatttctgcggtttcttgttgtaaggaattgattaattcaataaaacgtaacaaaacagttaccgaacggataggaattaaattttcttgaatggcaagctgagttgcttgccataaagtcacttgtctttcacgagttaaattacgcaaaatatctaaagtacgctcaccaatacctcgtggtggcgtatttacaacacgttcaaaagccgcatcatcttgtcgattggcaattaaacgcaaatacgctaaagcatctttaatctcttgtcgttcaaaaaatcgcataccgccataaatgcgataaggaattttagcccttagaaatgcctcttcaatgacacgggactggctattactacgatataaaactgcacaatcatcaaccttaccgccgttatccagccaattttgtacctgaccggagacaaacaaagcctcatccaactcgttaaaagccgcataaatccccacaggatctcctttttcacccgcagtccaaagatctttacctaaccggttactattattggaaattaaacggtttgcactttctaaaatgttgccggttgaacgataattttgctctaaacgaataattttcgcttttgcaaaatctttaagaaaacgatgaatattctcaacttgagcaccacgccaaccataaatagactgatcgtcatctccgacaatcatcacattgccttgcgaaccggctaataatttaatccaagcatattgaattttattagtatcctgaaattcatcgatcaaaacgtgctgaaaacgctgttgataatattgcaaaatatgtggattttttagccacaattcataagctctcaataataattcagcaaaatctactagacctgatcgatcacaagcatcttgataaattttatagatcttgatccactctcgttcttgacgatcattattatcttcaatctgatgagggcgtagcccttcttcctttttattattgatataccagcaggcttgcttataaggaaagattttttcatcatattgatgcaatttcatcaaacgcttaactaagcgaagttgatcttcactgtctaaaatttgaaaatcctgtggcaatccggcatctgcataatgggatcgcaataagcgatttgcaatgctatgaaaagtgccaatccacataccgaataaacgttgatgggaataacgagctaacgttgcctcaatacgatgacgcatttccgtcgctgctttattggtaaaagttaccgccataatacttgattcaggtattttttctaccgcacttaaccaagcaatacgatacgttaatactcgagtttttccgcttccagcaccagcaagtacgagataattccccaaaggtgcaacaacagcattgcgttgtttttcattaagatcattaagtaattctgaaatatccattgtcgcccataaactgtgtttttatacagttgattatattgttttaaccggaaaaagcaagataagaatcaccgaataaatgctgaagcatatttcgccaactttccttcccaaatgtccaatccgtttaaatatcaaacaaattttctacataactcgaatataaacggttatttcttctcgatcatgataaagatgttttgcttgtatttggaaagatatatgttgttcatttagtctttctttaatttgttgtaaacaccgcttaacctcaaaataacgctttttcattggtaattttaagttgaaaatagtttccttacaccaacctttgattagccattgactgattaaatcagcaattctatgtggctgttcaaccatatcgcaaaccagccagtcaattttacaatgcttaggaggccgaaatttaaagccatcttcagcacaatgttcaattctgccggtctcatgtagacttgttgccattttgccatgatccactgcatacacaaaaacacctcgtctaaccaattgataagtccaccctcccggacaagcccctaaatcaacagcatatttattttcgttaaaacgtgttgcttcttgattggggggaataaaataaagaattgcttcttctaattttaatgttgaacgactaggcgcttctgccggaaattttagtcgtggaatccccataatatgttcagcatggttattgttataggaatagccaatgtaacaactgttggattgagtgaaaaaaatatgcagagtaataccgctctttttgttttttgcttgtagccagccttgctttctgagagcttgtctaagcggtacagtaaattttcgacaaaaagcggcccgtgttttagcttcattggtatcggcggtttctacccaaatatcactactctgtttgagattgaggattttttcttgttgacgataatattcaataatcggactgatacgatcttgcacggaaagattactaataagatcagatacgacaatcagttggcgagcaaaaatcagttgactaaatgtaatctttctagcgaggagatccgcctcaccgatttggtaacattcaaaaataacataacctgaattttctactactctggcaaagccaaaaacaccaagtgcggtggctttttcggttatttccgccgccaattctttttcaaagccactgcggcaatataacgctaatttattcatgtttattttgcttcattgcatgcacaatccattgacggaatgcgttaatttgttctgtattggttcgattaagagaatttaccacataaaaagattttggatccggtagagagatagataacacaacttgtaagtttccgttctctatttcgtgttgagcaagaattttatttgccaacacaataccttgtccatgcacagcggcttgtaatgccataaatgtatgactaaataccggtccatgtcgaatatctaatttatccagttgaagtaaattcgccatattacgccagttatctctagtatgaacatgaataagattatgctgatacaaatctgttgcttgcgtaacaggttgtttagcgagtaatttaggggaagccaaaatcaacaattttgcctctgccaatttttcaacttgtaatcccacccaatttcctttgccataataaatggcaatatcaatttcattactcaaaggtatttcgtcttgatcaaccccttttaatctcacctcaatatccggatatcgttgattaaattcacttaattttggtacaagccattgcataccaaaagtttgcggaacgctaattgaaagatattgctcatttttctgagccattaattttgttgtagcatcggctaaattatttagaattttgctgacatcggaaaaataagcccgacccaaatcggttaattctaatgttctatttttacgcttaaataatataacacctaaaaaatcttctaataattttatttgatggctaactgcagcctgtgtaacaaaaagttcatctgcggctttagtaaaacttaaatgccttgctgaactttcaaaagatttcaatgaatttaaaggaggcaaacgtttaatcatcattcttcccaattgtattgtttaaattataacggttgaaattgctatcagattagtttttctaataccatatataaaaaaatatatcttgtctgacctatccattctccatagaatgcacgcatacttaacgattggtaattccttactggttaaagagtttcggacttaagtatgatgttgtgtttgcatattgttcgggaaaccgaaccgagtaacaaattttaagttactcatttacttcctgtatgtatatttaaaccgttttttaggttatgtaccgctctttatgagcggtatttttttatgggcaaaattctatcataaaatttcccatctctatcattccgagcgataaaaatccctttatattttaaatatccagtttccaacctgatgagaatagtgtagattaaattcactattttataaacatcaagaaggaagtaaaaatgaataaaaatattgattgggaaaatctcggttttagttatatcaaaacagattatcgttacattgcttattggaaaaatggagcatggtcaaaaggtgaattgatacaagataatgttttgcatatcagtgaaggttcaaccgcactccattacggtcaacaatgttttgagggcttaaaagcctatcgttgcaaagacggctcaattaacttatttcgccctgaacaaaatgcactacgcatgcaaaaaagttgccaacgcttgttgatgcccgaaattccggtggaaatgtttgtcgatgcctgtaaacaagtcgtcaaagcaaatgcagattggctaggtccttacggttccggtgcaacactttacttacgcccatttttaatcggtgttggtgataatatcggggtcagtccggctcctgaatatatattctcaatcttttgttgtcctgttggtgcatactttaaaggcggtatgaaaccgactaactttatcgtttctgactatgatcgtgccgcaccacaaggcaccggagcggcaaaagtggggggaaattatgccgccagtctttatccggggaaaatggcgaaaacacgtcattttgcagattgtatttatcttgatccgactacacacaaaaaaatagaagaagtcggttctgcaaacttcttcggtataactaaagacaataaatttattactccattatcgccgtcaattttgccaagcattactaaatattctctactctatctagcaaaagagcggttaggaatggaagtgattgagggcgatgtttatattgatcaattagatcaatttaaagaagccggtgcatgtggaacagcggcagtcatcacgcctatcggtggtattcaatatggcgatcatttccatgttttttattctgaaactgatgtaggtgaaataacaacaaagctttataatgagctggtcggtattcagtttggtgatgttgacgcaccagaaggctggattgttaaagtagaataataaaaaatacacaactaatctgcaatttaatcaagtaactttccgatgaaattgcagattttttctgacataaaaatatcttaacgttgttccaatgaatttaaataatccaagacaatttgatgatgatccgtagttttaaatttatcaaaaacttgttcaatttttccctgttcatcaattaaaaaactaatgcgatgaataccatcaaaggttcttcccataaactttttttctccccaaacaccgaattgttctgccacaatatgttgctcatctgaaagaagatcaaaattcaatgctttcttttctataaaattggctaattttttcggcgaatccggactaattcctaaaataacaacccctttattttctagctctgctttgctatcacgcaacccacaggcttgcgttgtacaaccaggcgtcaacgcttttggataaaaatagaccaatacttttttcccgtgaaaattctcaagactcacctgttcattattttgatttaatagactgaagtgcggtgcaaaatcgccggcttttaatgttttcataaaatattaccttttaaaaaatataaaaaaatacttgcaaagtgttgccattttaacgatcctaaacggactttttcaagctaatatgcaaacataataaggagattttatgaccacacacagacctttattctacggcagtatcaccgcacttatcacaccaatgaataatcatggagaagttgattttaatgcattaaaaaaattagttgaataccacattgtctcaggaactcacgctatcgtttctgtcggtacaaccggagaatcagctaccttaagtatcgctgaaaatgtaaaaacaattttaaagactcttgaatttgccgatggaagaatacctattattgcaggtaccggagcaaatgcaaccagcgaagcgattacgatgaccaagctgttaaatgatagtggtgttgcaggttgtttatccgttgtaccttactacaataaaccaactcaagaaggtatgtatcaacattttaaagccattgcagaatgtacggatattccacaaattctttacaatgtcccgagtcgtaccggtagcgatctattgcctgaaactgttggtcgtttatctcaaattgcaaatattgttggaattaaagaagcaacaggtgatgtcagtcgtgtagcgaaaattaaacagatggcgggggaagatttcattttcctcagcggcgatgacgcaacagggcttgaaagtatgaaacttggcggtcaaggagtcatttccgtcacaaacaatattgctgccgctgatatggcaaaaatgtgtgaattggcattagccggaaaatttgatgaagcagaaatcattaatgataaattaagagctttacataaagatttattcatcgaatcaaatcctattccggtaaaatgggcagcttataaattaggattagtccctgatccgatattacgtttgccgctgacaactttaagcgaacaggcacaaccgcaaattattaacgcattaaaaaatgccggattgctatagtcttcttactaaacattagggtctacaaacgcccctattttttaaccgatttctacgttaagtgcggttgttttgaggggcaaaataatttttatttttttctagacgtttgtattgtataattcgtcgcctactgttatgcgtacaatctacgcttatctttttacaaaataaggactttttatgaaatacaaactgtcgttagcgttattatttacgcttccagcctttgcccatgcgggggggggaattttaatttttatggcaaggcggggattgatttaacctctcgttttgaaacgatgaaaataatatcaaatattaatggagaggtaacaaatgttcctgcaagctcaagacaaaacaccttctcaccaagtatctttcttgaaacgacctacaatattttaccacaaacagaaattggtctcggattaggctatatcaaacgtaaaggcttcgatcatcatgcgacttggcagatcacacctgaaggtaattacggaataggtggagatgttaatgtaatcgaaaagtatagaataaatcgttattcctccctaccaatttatttcacgttgaaacaaaattatgcgttaaatgcaaatagtaaattttatctaaaaggggatattggctattcaattaacaaaattcataacacaacatatagttactattcagatctagatcataaaactacaacgactaatcgcaatatgaaagccaaaaacggtttgtatttaggtttaagtattgggtttgaatataagtctttcttagcggatattggatattaccatactcatgcgacggttaattacgaaagtaacggctactattcatggcatccttacaacaacgatgctatacgtttaacacttggatttaaattctaaacaacacaaaacagaataaatctttaagctaaacttttaccataaaaatccctattgaaatattattcagtagggattttaatattttcaatcggttacatttttnnnnnnnnnnnnnnnnnnnnnnnnnnnnagtgccattaccaccgcactttcccgctttccgtcaggtaaaggataataattcttacgaatatccacctcattaaaacccaaattgtgatatagctgtcttgccttaatgttcgtttctctcacctcaagccataaggtttgtatattacgttctaataattgttgaattaattctttcagtaattcttttcctaaccctaatccttgataatcaggatcgacggcaatattaaacaacgttgcctcatctaacacaagatgacaaatggcaaacgcaacaattttgccattaaccactttctttaaattaagataatgttcgccttgattattttttaatgtgcttaatgaccaaggaacaatatgtgctttttgttcgatcgcaaataattcggcaaaatcttgttcatcaatatatgaaatcattttctatatttcctgaatttgctgccaaaactgacgtttttcctgaggactttgctttaatctctcaagctcattacttttccaacaaggcatatattgcttatcgcttaaagtgcggtctattttctgttgatcgtttgtgagtaaccaataaattacttcatgttcgacttgaagataaggcaaaaaatcaaagtcaatacataaacaatcttctttcattagctcaagactacgaaaaatatcttgtaaaaacggttgttcttttaaaaccggctgttcagaaatcataatcaaacgaatattttttgccacagagacatttaccaacccttttaaaatctcgggatggcgtaattgccactgtgaaatacccatttcttgtaagagtttatctcgtctgttcatttctattttcctaaataacaggctattttaaaccgtaaccgaaatgaggttaagcaataattgtgtccatttttagctcttggatttgatataaagtgaagaaactcaaccgtagaagatcaaacctaaataagaaatcattaaattagttttgaccttctacactccagtagaattttaattcaaactttttgttcgagaagaacgcttacgagaagatttaattttatgaattggagaaagcttcacaaaatcaactccttccggtggattttctaatgcaattgttaagacttcatcaatagtgtcaaccgcatgaatagttaaattatttttcacattttcagggatttcttccaaatcttttacattttctttgggtataatcaccgttttaataccacctcgatgagctgctaataatttttccttcaacccaccaatcggtaatactttgccacgtaaactaatttcccccgtcattgccacttcagattttaccggattaccggttaaacaagaaaccaacgctgtacacatagcaatacccgcacttggtccatctttcggagtcgcaccgtccggtacatgaatgtgaatatcacgtttttcatgaaagtcattagcaatacctaacttttcagctcgagttcttacaacagtcatcgcagcttgaatactttctttcatcacatcgcccaaagaaccggtataaatcaatttacctttaccgattacagatgccgtttctattgttaataaatcaccgccaacttcggtccaagctaatcctgtcacttcaccaatgcggttttgtgtatctgctcgaccaaattcaaagcgtctaaccccaagatactcttgcaaattgttagaattcacttgaatagatttcaaacttttatctaatagcagatttttcactgctttgcggcaaattttagaaatctctctctctaaagaacgaacaccggcttctcgagtataatagcgaataatatctaaaatagcctcttcattgataaccaactcatcagtcttcaatccgttacgctcaatttgtttattcaataagtgacgtgtcgcaatattgagtttttcatcttccgtataaccggagagacgaatgacttccatacgatccagtaaaggtgctggaatattcattgagttggacgtagcaacaaacattacatcagataaatcataatcgacttcaagataatgatcattaaaatgtgaattttgttcaggatcaagcacttccaataatgcagatgccggatcacctcgataatccattgccattttgtcaatttcatcaagtaaaaacagcggatttttcacccccacttttgccattttttgaattaatttgccgggtaaagaacctatatacgttttacgatgtccacgaatctctgcttcatctcgcacaccgcctaatgccatgcgtacatatttacgccccgttgcgttggcaatagaatgccctagcgatgtttttcccacacccggagggccaactaaacataaaatagggccttttaattgatttaagcgactttgtaccgctaaatactccaatatacgctctttaacacgttctaagccatagtgatccgcatctaaggtttcctgtgctttggcaagatcttttttaactttagttcgcttatgccaaggaacttgaaccatccagtcaatataactacgcaaaaccgttgcttcggaagacattggcgacatcatctttaatttttgcaattcggcaaacactttttcacgagcctctatcggcatcttagcctcttctattttcttgcgtaattgctcaacttcatcaactgtgttttcatcatcattcagctctttttgcaatgccttaatttgttcattcagatagtaatcacgttgatttttttctatctgttttttaactctgccacgcacacgttgttcaacttgcaatatatcggcttcgcttaccattaatcctaataaatattcaaaccgtgccgacaaatctcctatttctaggatattttgcttttcattaatagataccggaagatgagctgcaaccgtatcacttaatctctctatatcattaatacgtcgcaatgcagaaataatatctgcgggaatttttttatttaaattcgcatatttttcaaattcggataaagtaattttcttcaatacacttaattctttctcatcactccattgtgtttcaattaattcgtgagacgctaaaaagaattccccattatcttgtaaatcaataagtttagttctttgttgtccttcaacaagaacttttacagtaccatccggcaattttaacaattgaataatattgactaatgtaccaatcttataaagatcagcgatcttaggttcttcaatgtcaggttttctttgtgaaaccaataataattgcttattattttccatcgcctcctctaaactacgaatagacttgggacgaccaacaaacaatggcattaccatataaggaaaaactaccacatcacgcaatggtagaaccggaagatgctctagcttagttcgttttgcgttcatataatttactctctttcttaaaaatagactgaatgcacaggatatgggggctttttgttaaagttcaagcgaaacccaacctgctaaaacaatcaacatcattctatctaaaatgctacaaaacatgccggcactttcttttgcttatttcgaagaaaattcaagcacctgttgtacgaagagtgatgtatctttagaaataaaaatctgcaccttaatcagttgtttattcactccaacttttagtgtgcagatcattttcaagtgcggtgtgtttttataaggattttactttttagggtgatccataaaacggaagaaatcactacccggttttaaaatcatcatattattcgaaccttcaaagctgttttcataggctttcatactacgcataaaactgaaaaactccggttcttgagcaaacgcatctgaatataattttgctgctgttgcatcgccttcacctcgcaactcttgtgcctttttacttgctgttgccaaaataaccacaactttacgatcaacatcagcttgaataaatgcggctttttctttaccttgtgaacgatgttcacgagccactgcatcacgttcagcacgcatacgttgataaattgaagaagatacttcatcaggtaaattgatctgttttacacgaacatctacgacttcaatacccaattcagcagtactatcttgtcctgtattcaatgctttcttcgcatcttccattaattcaccacgagtaccggatacaatgtctttaatagttctggagccaatttcagaacgcaaacgatcatttactttacggcgtaaaagattcgaggcttgtacataatctccgccactagtggctgtataaaagcgaccgaaatcactaattctccatttaacataagaatcaactaatagatcctttttctctacagtcacaaaacgatcaggttgaccgtctaaagttctaatgcgagcatcaaggattttgacgtgatcaataaatgggattttaaaatgcaagccagggctataaacaaccactttattatctgcatcacgatgtactttactaaaccgtagcataatgccacgagttccttcatcaataatcacaacacttgaataaatcagtgcgaccaatacgataagaataggagttaagaatttacgcattaattaaatctcccttgacgaccttctataacttgataaagactgttcggttgcgaaatttccggatttgttaccgctctttcaggaacctttttttcacttgattgatcagttttaacgagcgtattgcttttctctgctaacgttttactattcaagatctgctctaacggcaatacggttaaattatttccactctgtgtatctaacatgactttcggtgtattcgccatgactttttccatagtttgaatatacaaacgttcacgtaataattccggcgatgctttaaactcaggtaataaacgttggaaacgctctacttcaccttgtgcatccaacacaacttgttctttatatgctgtcgcctgctcaataatacgttgtgcatttccacgagcccgtggctcttgctcacgagcataagcttctgcctcacgaatatagcgttgctcatcttcttgagccttaattgcatcatcgaaagccgctttcacttcctccggagggcgagcagactggaagttcacatcaatcacttctaagcccatatcataaacagcaatgatatcatttaaagttttccaagtattttcacgtacaactgaacgtccggtagttaaaatatcatccatcgtcatatgaccaattacataacgtaatgcactatctgtcgcttgatttaaactgtcatccgctctcgttacactaaacaaatatttcgccggatcttgaacacgatattgcaccgtcatctcaaccttaaccatattttcatcttgcgttaacattgaaccctgtgttcttaattcacgaacccgctcaacattcaccgctgttacgctatcaataaacgttggtttccaatttaagcccggctgaacgattgaatgtaattgtccaaaacgaagaactacaccacgctccgcttcttttatggtataaaacccgcttaatccccaaatcaccgcaccaatcaatacacctaacggtaacaatttacctaaccccaccggagaatttggcttgccgttttttccgacattaccggatttaccactgatttttttcagcaaattattaaagatctcttcaatatccggcggtgattgttgagtattcttttgttggttattcggctgctcccaatttgactgtttatcttcattatgggattgattattttccggttttttccccgtgctacccggcttaccccaaggatcttgatctgaattattgaacgacatttcattctccatttgtcaaaaattgtgacaagtctaaacaaaatattgatctaagtctaatttatttaaaactaattttgcgatttatttggtattcctcacacaaaagcaaaaaaataactcatttttcaaactctgtaatgataatcaccgcacttagaggtaacaacacagaatgatgaaaatcacctttcaaacgaatggataagaacaaaaaatagttatttaatagcaaaaaattcagaatgagaaagttattcagaagtgataaaaatcgccgaataatcggcgattttgtataaaatgaatcaatctaaccgtttagacatagctaaccaatcggctttaaattcacgacgcatattattaattgcatcaataatatcatgatgcaccaattgttcattttggataccgacacaataaccacctttgccctgtaataaaagatctacagcgtaaacccccatacgagaacctaaaatgcggtcaaaagcacaaggcgtaccgccacgttgaatatggcctaaaatagttgctcgagtttcgtgttttacacgggcttcaatttctcgagccagctcattcacatcacataataattcagtgatggcaataattgcatgacgcttacccttaataatggcacgctcaatttgcttaattaattcttcacgattaaattcaatttcagaagcaacaatatattcacaaccacctgcaatagccgccgagatcgtcaaatcgctacaatgtctgcccataatttccacgatagaaatacgcttgtgtgaacttgaggtatcacgtaaacggtcaattgcctcaactgcggtttcaagtgcagtttgataaccgatagtataatcagtgccagcaacatcattatcaattgttccaggaataccgacacaaggaaaatcatgttcttcagtgagtaattttgctcccatataagaaccgtctcccccgatgacgacaagtgcatcaataccatgtgaacgtaaaatttccacgcatttttcacgtacggcaggatctttaaactcagggaaacgagctgagccaaggaatgtaccgccccggttgataatatccgatacgctatagcgagttaattgttggatcttgttgtgatataaaccgtaataaccttcataaatcccataaacttccaagccctcggataaagccgaacgaacaacaccacgtatcgcagcattcatccccggtgcatcaccgccacttgttaaaactgcaattttttttatcatattacttacctaatgtattgttaaaattaatcttcaaaaaaacagtgccaaggttacactattccttgccgtcgctctataaaaatttttgtgaattgcaacacaatttgatctagtttaaatttttcagctcaacttgaacaacgctggttggctcttgatgaatcgcaatatcagcgtaagaaaatcgctgtctcaattgattttctatatcttctgtaatttgatgagcttgaagaaaagacatatgatcatctaattctaaatgaaattggataaaacgaaccgcacctgaacgtctggttttaagatcatgaaaacccaaaatacgtttatctgctaaaataatttgttctatgcttttaatttcttcatccggtaaggcaacatctaaaagcaactggagattatcaaacaagattttacctgcattaatcaatatataaaaagcaattaaaagagcaaaaatcgcatcggcttgttggtaacctaattggctcaacgataatgaaattaaaatagtaaaattcatcaataaatccgtttgataatgaagtttatccgctttaattgccggactgcctgtttgtttaatcactttgctttgatatatcactaacaatgcagtagctaaaatcgaaaataaggttacaaaaacaccaatctgaaaattcatcaagggttgtggtgtatttaagcgatgaataccttgcagaagaataaataccgccgatccggaaataaatgcactttgccccaaaccagcaagagcctcagccttaccatgaccaaaagaatgattatgatccgccggcatcagtgcaaaacgcaaaatcagcatattcatcaaagacaccaataaatccaacattgagtcagtgatagacgctaacatactgacagaactcgtttgccaccaagcgaaacttttcactaaaattaataataaagcggtaaaaatagctaaattggctgcttttttcacttgttgggaataaatacgttccatttatacaattgccctcattgataacaaccgactattttatattgttcgagctgtgcgatttctttatccacaatatatttttttaaatagcgttcaattttacgtttactcattgctgatatgggagctttcattaacttaaaagaatactgatattgaacaaaaccacaaaaaggaacctctttaccttttgcaatatctacttgccaagttggatttgtttctgtcggttcataaatcacaaagctgtaaagctcattatctttcaaataaagattaaattgcttcacaccgttattctgataaacatgtcgtctcaatgttatacgatccgacaaactacgtttttcacgattacgatcatgtaataattcaaccgcactttgccagttttcaacagtatgctctttcggtaaataaaagtaacgagccacagtttccaaatctaccgcactgacaagataataacttttttcatgatgcttaatatattccggtacgtttactcgagagtgtgatacacaggctgacaataaaagtgcggtcaacatagctaagattttgttcatttaattacatctcgcttaaatacaaattccgtttgtgttgaagaggatggattaaactgatacccccctaaatcaaactcttttaattgttcaatgtcagtgactcgatgttgaataatatagcgacacatcaaccctcttgcttttttagcataaaaactgatgactttatattttcctcctttgttatcaaggaaaaccggcttgataattttcacttctaattgattttctttaatggatttataatactcatctgaagccaaattaacgagaattctatcgccctgctgttcaattgcctgttgtaatgcgtcggtgatgatatttccccaaaaagcatataaatccttgcctttttcatttgccaattttgttcccatttctaaacgataaggttgcattaaatcaagcggtcgtaacactccatataatccggataatacacgcaaatgctgttgtgcaaattgaatatcgtcccgacttaatgtttcaacctccaagccggtgtaaacatcacctttaaaagcataaattgccgcacgagaattttgttcattatgctctatttgccattgttcaaagcgtacgacatttaagccggcaagtttatcgctaatcgacattaacgaacttatttgtgccggtgaaagttgacgacaaatgtttatcaatttttcgctatatgcagttaagtgcggttgagaaaaagcaaaattcggtaccacactttcccaatctaacgttttggctggagaaataatagctaacatgttctttcctcaaatttatatcgtcattggcaattgccaattaatttcagttaaattgtgatgtcgtaaatactgattagttttggaaaaatgcctacaaccgaaaaatcctctatgtgccgacaatggcgaagggtgtggcgaggttaaaacacaatgcttagtgcggtcaataaattgaccttttttctgagcatgactaccccaaagcaaaaaaacaagatgatcacgttgttcatttaaaacatgaataacacgatccgtaaacgtttcccaaccaaaattcgcatgtgaatgtgctaatccctgttcaacggtcaacaccgtattgagcaataatacgccttgctttgcccaaccgaccaaatagccatgtgaaggagtttgaaaccccataatatctgttgagagttctttataaatatttaccaatgaaggaggcggtgctatgccgggtttgactgaaaatgccaacccatgtgcttgattgacaccatggtaaggatcttgacctagaatgacgaccctaacctgatcaaactccgtcagtctaaaggcactaaatacttcttcttgaggtggataaattgttctaccgctttgtctggcttgttgaacttgctgtaaaatatgctggaaataaggttgttgtttttcgtgcccaattgcctctttccacgtattcatgattttcctcatattgatatgccaatcttaagcggcaattataaagaaagaataataaaatgcctagtttggatttgcttaatacgtataggttatttttaaattttgctgattttaacgccttgattacgtttcaatccaatatattttttcaataaaattaaaccgctctatatcaaattaattgaaaatataaaattttttgataaaatttgcaccagttcaattcgtgaaaaaacataatgattaggagcatattatgattaaaggtatccaaattactcaagcggcaaatgacaatttattaaactcgttttggttgttggacagtgaaaaaggcgaagctcgttgcttagcggctaaagcggaattcgttgaagatcaaatcgtggcagtaagcgagttaggtcaaatcgaatatcgtgaattaccagttgacgttgcaccaacaattaaagttgaagggggtcaacacttaaatgtgaatgtattacgtcgtgaaacattggaagacgcagtaaataatccggaaaaatacccacaactaaccattcgtgtttccggttacgcagttcgttttaactctttaacaccggaacagcaacgtgatgtaattactcgtactttcacacaaagtttataatttccatctgatctgatgtgccgtattcccacatactttaaaacgtggaaatacggcacaaaatattctcgtcgactttactctccgatcttaccttattttttattgcaacaccgaaatgtctgctacttgtaaaaagagattttgtagcgtgcttaaaatcgctaagcgattttggcgaagcgtttgttcttccacatttaccattactccgtcaaaaaacgcatcaatcggctgacgtaaattcgctaatttatccaatacagccgtgtagtcgccttgtgcaattaacggttgcacttcgccttttaaggcaataaccgcttccgccaacgttttttctgccgactctacgcaaacgcctaaatcaatctcaccaatcgcaatatcggctttcgctagaatgttgctcacacgtttatttgcggcggctaaggcttcggcactgtctaatgtacggaaatgagaaaccgcacgcacacgagcatcgaagtccgcaggtttggtcggacggcgagccaatacagattgaatgacgtctactgcaatgccttcactttcataccatgcacggaagcggccaagcataaagtctactacttcatcaaccacatttttattcgtcagtttgtcgccaaaaagtgcggtcgcttttgccacaatgtcaactaaatccaacggcaagtttttctccacaataattcgcagacaacccagtgcggcacgacgtaaagcaaacgggtcggcactgcctttcggggattgtccaataccgaaaatccctgtgagcgtatcaattttatccgccaatgcaacagaacaagcgactaacgaattcggcaatgtatcaccggcaaaacgtggcatatattgttcgttcaacgcaaccgccacgtcttcatcttcgccatcgtggcgagcatagtgcatacccattacgccttgcgtatcggtaaattcaaacaccatattggtcatcaaatcgcattttgagagcaagccggcacgtttcgctttcgtttgatccgccccgatttgtgctgcaatttctcctgctaaggcttcaatacgagcggttttatcacgcaatgtgccaagctgctgttggaataacacggtttcaaggcgtggcaaccgatcttccaatttctgttttaagtctgttttgaagaagaattccgcatcggtcaagcgtgggcgaaccactttttcgttaccttcaataattttgctcggatcgtccggattaatattggacacgaagataaagtgcggtaataattttccgtctttatcataaatcggaaagtatttttggtcgcctttcatcgtataaaccaaggcttccgcagggacggcaaggaaacgttcttcaaatttagcggtcagtacattcggatattcaactaatgacgttacttcttccaacaactcttcttcaatatccgccacaccgccaagtgcggtcgctttttcttgagatgttgcaaggatcaacgctttacgttcattgaaatcggctaccacagaaccacgttctttgagcaattgcggatattgatcggcgtgatcaagactaaattcacgctcacctaaaaaacgatgtccacaaacggtacgcccgctcgccacgcctaaaatttcgccttcaatcagatccgcaccgaataaaagcgttacggtatgcaccggacgtacaaactgctcggttttatcgccccaacgcattgtttttggaattggtaatcctgcaagggctttatcaataatgcctacaagcaagtttttagtcggctgaccttcaatcactgcacgatgcaccagccattcgcctttatcggtggcaagacgttcggcttgctcaacggtaataccacagcctctcgcccagccttccgccgctttggtcggcttaccttcggcatcaaacgccgccgatactgccggcccacgtttttcaacttgtttgctcggttgagcctctgccagccccaacacttttactgccaaacggcgaggggctgcaaaccattccactttctcaaaagccaaccctgcttgatttaactcttgctcaacattctccgcaaatgcggtcgctaattttttgagtgcctttggtggcaactcttctgtgccgatctcggcgaggaagttttgtgctgtcattgttatttctcaactatacgttttatttaaatccattggctaaacaaattgctttgttcgttttttggggtacttttactcaattcttcacatcgtttttacgtctaccaaataccctaactcaataaaaatcaaaaggttccgttttacttgatatcgttttgaactcattttcttattctacactattttagatagaggcaaaacaagattgcttttgaaaacgctcaatttgccttttcgttgtactgcgttttaacgttttaaaaatcaatctaaactcatatcaaagtaacccagacaagaaaaagaaaaagaaaggataaagagaagagaagaattttattttttttgcgataaatttagacaattttgtagcaaatttataactagatcagtataatcgcacacttaactaaactggatttaatcatttgagaaaatagctcaaatcaaccctattaacattaatcgaataagaagcagaatatgagcctacagcctacagcctacagcctacagcctacagcctacagcctacagcctacagcctacagcctacagcctacagcctaggctaacgcctttttataaaccttgcaaaataaattttaaaaagtttttaacttctcgtcatacccaaatttccccttttaaccccctttgcgaaaatatcattcgcctttttttgctttgccttaaaaagcaaggtattgcctatttagggttatcccctctctctaaagtttaataaataatcagtaagagataataaataaacaatcaataacagattcgatcaataaccatttaacaagtcattcaaagataatttttaaagcgagtaattctatgaacaaaatatttaaaaccaaatacgatattacaacaggtcaatgtaaagctgtttccgagttggcaagcaaccgccaaatagcgagcagttcgaagagtaaatcaaagtgcggtgtgtttttsggyggtatgttaggggcgtttaaggtcctgccgttggcrttggtratkgcggggttttttggggtgwgcagtgtttcatatgctgagataacatatattgatatggatggaaggacaggagcagcaggtgtacaagaaaaatggggtgaagcaccgcattggaaagataaaaaaaatattttgatagcacctgtgcaagataaaggtccaaatttaaataaatttggtggaataaatacaaatgtacaacattctgtaatcataggaccacatgctgccggtagacaacataaacaaggtatgactgtattggggcatggagcagttgggtacgaaagccaagcgacagctttaggaaacaatacatatgctggaggacaagccacagcaattggttctgatgtaatggcaggaggacttgcctcaatagctataggaaatgatgatatatatactgatgttggattttcagatacgttgcctgaagagactattttgaaaatttatggatatnnnnnnnnnnnnnnnnnnnnnnnnnnnnnnnnnnnnnnnnnnnnnnnnnnnnnnnnnttagatcaaaatgagtttaagaaaaaatatgttagaaatggtcatataaatactaaagtatattccccaacatatgcagccggagtggcagcaatcgctatcggttcaagatcggttgcttatggtgatacttcactctcaatcggtacattatcatttgcattaggcaatagatcgactgcggtcggctttcgtgcgtttgtggattttgccgcagaaggcggggttgcgatcggagatgaatcacgggtatttgccgcgaattcctttgcagtaggaaataatgccgaatcaacgaataaaggggcgttatcctttggtagtttctcaaaagcagtaggtgagggttctatcgctataggacaaaatgtagggtctaatgccaagttaagtggtagtgctgacaccgaacttgaaaagttgattatgagtactacacaaactgctcaacctaccgtatcccctggggatcatggaagtgcaactattgcatatgacaatagctcacctgataaacaattaaaattcggagataagaatgagattgttacacttggatttgctgcaaaaaacaaaacagaaaatccagtttctaagctaattgataaggtagtaacgaaaaaagaaaaacaaaaagatcagctacaatatgcttttgacaaaagcaacggcgaggtcatcgaaaccactgaaaaaatttataaaactcaaaaagaaggcgaccatgcgatttcgctgggctatcatatttccaacaacggcgataatactattgcgatcgggagtgcttccatcgtcagaggatcgaactcggtcgttttgggggcattaaataacatcggtaaatatgcacgaaataccatcgcacttgggattggtactaatgtatataaagaaaactcggttgctatcggtacgggggtcaatgttgccggtgcgggggttgtggctatcggttccggtgtgggggttacgaaagataacaccatcgccgtcggctatggtgctcatagtttatcgggcgaaagtattgttttaggaaatgatgcaagcctaaaagaccatgcttccaaatctatcgtcatcggacaccatgcacaagttgagaataaacttactgagccagataaacagcagaaaatagaaaaagtaaaacaagataagaagatatttttaggtggcgacaatgtagaattagagatgtccgccattgcgataggggcagactcaaaagtttatgctgaaaaaggcgtagcattcgggaataatgcacaagttaaggaaactgctagtagtgcaatggcattaggtaatgatgccgaagcgacgatgcaaaactccgtggcgttggggtataaatccaccaccaaatatttttatgaggacaaaacgggcaatactgcaactattacctcatcaaacggaccaaccgttaaaaatgacagctctaccaagaccgctacgttaggcgggaraaaagctattgagttagctccctatattccggaggggtcaagttacgatttaaaaaccgatgaagcggcaggtattgtgtcagttggttggataaaaaatggaagtaatggtagcggtcaagaacttggattgagaagaattgtcggcgtcgcaccgagtgcgttggattctgacgtggcgacgattgggcaattaaaagccttagcttatgtgaaaaaagagggcgtggttacctactataccgaacagaacgggaagatatataaagtcgttaaaaatcctgagggtaaattctttaaagtcaatacggacaacggaacaccgctcgatgataaagaaattgataaaaacaaggtttttgccggtcctaaaggggcgaatgaacaacctgtcatgataaatggcaaaaaaacagcggatatgggcgaactaattaaatttggtcatatcgccgatggtaatattgccgataaatccaatcaggcgattacgggcaatcagcttaatcagcttggtaaaactattttaggcttgaccgtaaatagtgataaaacaaaatttgatacgcctagttttgtagcggttaattatgaaggagcacaatccggaacaaataaccagccaacaacatttaaaaaagccattgatgaactgattacggcagtaaataaagggcttaacattgcaggagatgatgcaaacggacaacttaccctaggctcaactttaacgattaaagcggggaatacaacggttgaggataaggtactcaaaacaacaacagaatataaaagcgataatattagaacagcctatcaaccgactagcaaaacacttttaataggcataaaagaaaatccgacatttaaaaaagttacattgtcagaagaacaaacctatccttctggtacacaaaaaaataaggtcggtaaaaacgacttaattactaaaggctatttagacggtgcattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacggcgacaattcctttgcgttgggtaaaaattctacatgggaagggaaaactaccgctgcgaccagtgcagatattaatgtgggttcagcaagtttgaaatttgactggaacaatgcaggagcaggggcggataaagaagttgtcagtgtgggtagtcaaggcaatgaacgcataattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcggaagtggatagcggtacaaaacaattcaaagcaaccacatttaccaagttgaaagataaagatggaagtgagacatctccagcaccaacgacattcaaagaagccattgagaaaagcattgaaaccattaacaagggcttgaagtttaaaggcgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatcgctttgaataaggatttgaaaggcattacctctatcgggaaagatggggataatgttttaacgtttgcaaatggtgcaagcggttcaagtggtggaaactcagcggtattaaaagtcggcggaagtgaattaacctttactaaagcagatggtaacaaagttacaattacaggcttggcagatggaaagagtgatggcgatgctgttacagtcaaacaattaaccgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatccatcggtgtgggtagggatacgaaaatcaccaatgccgaatgggcagtcgctatcggtaataacaccaaaattacgaacggtaatgacattgtggcgttggggtcgaatattgaggtaacgggaagtaataatgatagcgtactcgtattcggtaacggtgccaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacaaaaccgtagtcagcgtaggggataagggtagcgagcggattatcaccaacgttgccgcwggtaaagtcgaaaccggctcaaccgatgccatcaacggcggacagcttgcggaagtgattagcatttttggtaaattaggttttgatgtacttggtgcagagaaacatgatacagatgatggctttaaacaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagcagctgcaccgccgtctgcttcggcaagtagcacaactacaacaccaaccacgagtacaacaacgactggtacaccaaccgcacctactacggctgttgttaccatagcgacaaaagacgagttagaaaatataaaatctatctcctcacctaaaggaagtgcggscggaaatggtgccarttcaamtggagaartcacyaaacttactttaacttcagaaaatgcsacattccaagtcggtacaacaggtgcgaaagtgaatatcaataaagagggtatttcactyacaccacaaggggcgaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacaggmaaaatcaccggtctgaaagatttagaagcaaattctgacggcacgagtgcrgtgaataaaaactatgtggataaactggataaagtgacggtgaaatatgatgatgaasataaaaaatcaatcactttaggcggtaaacctmaaaatggaggtaaggctcatgaccctgttgccatcaamaayctmaaatccggtttagggcttgatgatatgaaagataaaccggattctcaaaaaaatggattaagtcttgagctagtgaaaaaactggtttcyracggyatragtagycagcaaggrcaacaaatgacaaaagawgamctrcaymaagccgcyaatctcgctgatttraaagcggttgcacaagcwgggttgagatttaaaggaaatcagggcgatgatgtagtcagaaraatcagcgataccttaactattaaaggggaagaaaacgctacaactggttctagtgccactgacaagtttaacagtaatactaccgccgctggtaacattaaggtagaagccaatacagccaaagatggtttagaaataaaactgtcggatacgttgaaaaatatgaaagcctttgaaaccaaagaggagagcggtaagaaatcgacgttaaatagcgagggcttaactgttgagaacaaaggtaaagatggcaatagtaaaggtacctctgccacctatggtgcggacaatatcatgttggaagataaaggtaaaaacaataaagcaacaataactgctgaaagccttacctttgctgacaacgtagcacaaaatcagcaaaatccaatgccaaaaaccgttcttaataaaaacggcttaaccgtaaccggcaaaggcggtgaaattaagattgatggtgaaaacggtattattaccgtaccggatattaaaccaacaaccagtggaagtgcggtggtgaataagaaatatgtggatggtcaactcagtgccgctgtcaaccgcttggataatgtgatcagtgccaacaacaaacgcttgcaatcaggaattgccggtgcaaatgcggcggctgcattgccaacgattgcgatgccgggtaaatcagcacttgcagtctctgcgggtacctatagagggcaaagtgcggtggctttgggctactctcgtgtgagtgacaacggtaaaattatgttgaaactacacggcaacagcacctcaaccggcgatttcggtggtggtgtcggtatcggctgggcgtggtaagctgaggtcaaactatcaaaaaaagcagtgataatctgttccttggtcagttgtttttttaatccaacttctaggtgaagatcagaatcactgcttttttgtttgttggtgcggtatttgcctgagagcaatgcatgataaaaaatagtcagttaaatactgaataacgatgccataatgtataggtgaaatttcgagataaaagcaaaaatctattacatcatttcattactaataaatttagcgtaaaataatgccatctataattacatagcagaaataaaaatgagcctacaagcctacaagcctacaagcctacaagcctacaagcctacaagcctacaagcctacaagcctacaagcctacaagcctacaagcctacaagcctacaagcctacaagcctagtatattggctaaaaacaaccttgcaaattcattatgaaaggttgttaatgtctaaacaaaaatccaagaccaatcaatctcaatctattactcaaaatagttttcgtttttttgatgcctataaatcattcatagatttaaaagattgttgtttatttctcagaacgaacgatatcaatactattggtatgtttgcagttaatgtacttgcatttcctcacaaaaaaacaccgcactaaaataagatgttccgagaagataatatgaatttaattatatgctgtactccattacaggtaatcatcgccgaaaaaattatcgaacgttatcctgagcaaaaattttatggggttatgttagaatcattttataacgataaatttgatttttatgaaaataaattaaagcacttatgccatgagtttttttgtataaaaattgcaagatttaaactagaaaggtataaaaatttactttctttattaaaaattaaaaacaaaacttttgatcgtgttttcttggcgaatatcgaaaaaagatatatccatattattttaagtaatatctttttcaaagaattgtatacttttgatgatggtactgcaaacatcgccccaaatagtcacctctatcaagaatatgatcattctttaaaaaaaagaattactgatattctattacccaatcactacaattccaacaaagtaaagaatatatctaagctacattattcaatttatcgttgtaaaaataatattatagataatatagaatatatgcctttgtttaatctagaaaagaaatatacggcacaagataaaagcatctcaatactattaggtcaacctatattttatgatgaagagaaaaatattcgattaatcaaagaagtcattgcaaaatttaaaattgattattattttcctcacccaagggaagattactatatagataatgtttcatatattaaaacaccgcttatttttgaagagttttatgcagaacgatctattgaaaataatattaaaatatatactttttttagtagtgcggtattaaatatagtaaccaaagaaaatattgaccgtatctatgctttaaagcctaaattaactgaaaaagcatatttagattgttatgatatattgaaagattttggtataaaagtgattgatatttaaaatttttggcaaaaaaaaataaataaatgatcttaaattaatccgtaataatgaacttcattattcactttataaagcaagctgaggagtaaatgttacggtaagttcaaccagttcatctaaagagattattttcatttgcggtaactgtacaaatattttctcacttaaatttcttgcctcaacatcaggttgtaaaaacataacaggtatattaaggcaagcaaaaagttgagggtgctttaagggtaataaaacagcatcttgccataaaactaatacatcttgtggtgtgatttggtctaaataaccggttaattcatttatgtcgtagcttgattgagaaaaggtatagagcatattatttatccctaaaaagttaaaattttctctgcctgatttagtttttgtagcaacaaaatgcggtcaattttttgacaggaaataataaaatcttggctatttaattgatatttttcacaagattgccgacaaatataacgttgctcgatttcatacaaatccaataatttaaaggtactaatgaaatctttttgcaaaataatttcaggtttctgctgattaagtaaattaaaaacaccatcttctaagaagaagaccgcaatttcatcttcattacaaaatgccgttgccgccaacagtgcatctaaaccttctcggctgatactgctaccgtgtggtgcttggcgaaagataaaagccagttttatcatattgttatcaacctatctgcttgcaaaactgccttattaaactctcctaatcctgccaaaataaaaccttctgctaaattattttgttgctggttatttgaactcagcggttcaacgatacctcgccgttgtgctgctgaaatacaaagatgcaatgggatagaaaatgtttgactcaattgttgccacgctttttgtaaatgaaattcgtcatttgccggattgacaaaggcattacctaaagttaccccttgttgaaaaaaaaagatttgttcaatttgatgacctttcgccaataaggtttgtgcaaattgataagcaagatatgccccttgtgtaccataaacaggctgtttaaccgctaaaacataacgcattattctattccttgctcttgtttgagttgacggatatagagataaacggtatgtcgagagatatttaagcgttccgctactaaattaatcgcatctttaatatcaaaaatacctttttcatataaggacaggacaatttgacgatttttgttatgatttgcaacaagacgatccgctgtaatttcttcgatagtttgttctatagtttgaacaacaagctcctctactgaactggcgaaattaactgctgacatttccacttgttcaggtgcgggcatcaatgcctgaataaattgagacatgggaatatccaaattaatattaatgcaaagtaagcctataatgcgttgattaccgttacgaattgcaatcgtcaccgatttcatcaatcccttacttttagatcgagtaaaataaggtttagacacactctcggtttgcatattgtgcaaagacgttaatgcaaaatttgtaatcggcgaccccacttggcgattggtattatgtccattggcaatacaaatagccgaatgctcaaggtcttccaaagagtgtaaaacaatttcacagtgctcaccaattaatgcactaatcccctcaaccacagcgatataagaattgagaatagtatgatcttcatttgtaaaagggcgtctatccgataacatgcttaatttcccttatttttctcaccgcactttaggctatttttaatgtaagtgcggtgagttttactttatttttcagaagttacatctaagatttcaatatcaaaatatagcgttgaactcggtggaattaggcctgcacctctttcgccataagctaagtcggcaggaataaccaactcaatttttccgccttttttaatgaattgtaaaccctctgtccaacctaaaatcacttgatttaatttaaattcagcaggttgtccacgctctctggaactatcgaatactttgctattggctaatttgcccgtgtaatgtactttaacacgatctgtcggtttaatgctcttaccttctcccattttttcaatacgataaagtaaaccgctttccgtttttttcacattcgattttttagcaaattctgctgtaaatttctcattttcagctttgattttagccatttttgcatgacgtgctttgttttctaactcttgcaacgtttcttgtgctttttcatcagttaaagtgcttttattttctacaacatctttaatgccagcgacaattttctcataattgtaactggcaacatctttgtgttcttcacccatcaccgttaaatattttcccataaaatagcccaaagcataagaaacatcatcattgaactgcttatcagcaaaaacagattgagaaatgaccgcacttgctattaacgctattgcagaacgttttttaatttttaacatttttcttgatcctttataataaaaatatgaaatgttgaatagattaaattgtcttgttcaaatgcacaatcattattttttaattagagactatttatgccacaaactcaagaattagatcaacgtattgcagaattagaaatgaaaattgcctttcaagaaaacaccttagaagaattaaatcaggcattaattgatcaacaatttgttttagacaaaatgcaactacaattacgctatatggcaagcaaattaaaggatttacaatcttctaatattgcaagtcaagcggaagaaacacctccgccacattattaacttattgatacacatcaagaatatcaataggataggttttttcggataaataatcttccacggcttgtaataccaaaggattgcgagccgcttgtccatcttgctgaatataatggtgaaactcctccaagctcaaccaaagccctccggaaatatccggatcagaaggtgttatctcaacccaatctgttaactcaacagaaaaaacaaaacgtaaataatcagttttagaacgaggtgcatgccattggtaaatctttaataagttttgcatctctgctcgaataccggtttcttcaaataattctctttgtgcaccttgtaaaatagtttcatttttttctagatgcccagctggttgattaagcgtcattttgccgtattcaaattcttcgacaaataaaaatttgcctttgcagtgcacaacacaagccattgtaatatttggtttatacatattagatactctttttaacttgttgatataaatcttgtaattcggttaacgtaagctcacgaaattgtccattggctaaattggtgagcgttagccccgctgtttcataacgaattaaacgcaatgtgggaaaaccgatatgggcagtcatacgtcgtacttgacggttacgcccttcgctaattttaatttccagccagctggtaggaacagttttacgctcacgaatcggtggatgtcgttgccaaatattcggttcagaaatcaaccgcacttttgccggtttggtcaatccatcattcaattcgatgccttttctcagctgtgcaagatcggtttccactggaatgccttctatttgtacccagtaggttttttccattttaaattttggattcgtcagtcggtgctgtagctcgccattattggttaacaataaaagaccctcgctatctcgatctaaacgtcctacgggataaatgtgcggtatttttataaaatcttttaatgttgcccgcccttgttcatctgtgaactgacagagaacatcaaaaggcttgttgaataaaatcactttagtttgtgcaaagttaagtccccttttttgcctacgtttcagcaccgcactttttacaagcgattttatcaagttagtgttgtttaattttttgcgttgaagatccatgttttagataaaaataaataagggcaagccattagctgcccttatgctgattagatttttgccaaaatattattcaatgttgctgaaggacgcatggcttgtgctgtagccttggaatcagggtgataataaccttgaatattttgcggcgtcccttgtgcagcaagtagctcttgattaatttgctgctcattttcttgcaaggcttgtgcaattgactcaaacttcctattaagttgttcatctttgttttgcgctgctaaggcttgagcccaatacattgccaaataaaaatgcgatcctctgttatcaatcgtccccaatttacgtcccggagatttattcttatctaagaaaattgcatttgcctgatctaatgtttctgccaaaatttgtgcttgatcgttattttgcgtttgagcaaggtgttccagtgaagcttgtagtgctaaaaactctcctagcgaatcccaacgtaaataaccttctgcaataaactgctcaatatgttttggtgcagaaccgccggcaccagtttcaaataaccccccaccattcatcaatggtacaattgaaagcattttggcagaagtacctaattctaagattgggaataaatctgtaagataatctcgcaacacattaccggtagcggaaatcgtatccaacccttgacgaatacgatttaatgaaaatttgcaagcctcaatcggagataatattttgatgtctaaatgtgttgtatcaaattcagccaaataagaccgcacttttttgataacttcacgatcatgtgcacgattttcatctaaccaaaaaacaaccggcgtattggtaacgcttgctcgattaactgcaagtttaatccaatccttaattggtgcatctttcgtttgacacatgcggaaaatatcgcctttctccacatgttgcaccaagtaaatttcgccatcttcaccaaccacttgaattaccccttgctcttcagcttggaaagttttgtcatgtgagccatattcttccgctttttgtgccattaatccgacattaggtactgaacccattgtagtaggattaaaggctccgttatgtttacagtcttcaatgaccgcactataaatccccgcataacaacgatccggaatgagtgccaaggtatcttgtaattccccttttctgttccacattttgcctgaattacggatcattgccggcatagaagcatcaacaataacatcagaaggaacatgcagattagtaatccctttatctgaatttaccatagcaatatcaggtccttgctccattgctttttcaattgccgctttgatttcattttccttagcatggccggcgattttgctataaagctcacccaacccattgttcgggttgatgctaagttgagtaaacacatcagcatattgtgcaaaaacatcggcaaaataaacagaaacaataacaccgaaaatgataggatctgatactttcatcattgttgctttaagatgtgttgaaaataacgtaccctccgctttagattgagcttttgcttgtgctacaaaatcttttaacgcttgtaaactcatcactgaggcatctattacttcaccagcttttaacggtgcaaattttttcagcactttcttttcaccgtttgcagccacaaattctatttgaaattgtcccgcactttttaccgttacggatttttccgtaccataaaaatctccttgttgcatgctgacaacttgggtttttgattgtgcagaccaatcgcccattgagtgcggatttttctgtgcataatttttcactgcttttggtgcacgtcgatcagaatttccctcacgtaaaacgggatttaccgctgaacctaatacttttgcgtaagccgcttttatttttttttcttcttccgtctgtggttctgttggatagtcaggaacagcaaatccttgttgttgaagttctttaatggcggcgttaagttgaggaatagaagctgagatattcggtaatttaataatattagcttccggtttagtcgccaattcacccaattcagcaagggcatcaggaattttctgttcctcactaaggtaagcagataaattggctaaaattcgccctgcaagagaaatatctttggtttctacatcaatatttgcgacagcagtaaatgcttgcacaattggaaggaaagaataagtcgccaacattggtgcttcatcagttaatgtataagtaatttttgctgacataggcatgttcctgtatagatatgaattggttaattggaatgaatttgctctttatggtattagagcgttctaagcataacaaaaaaataacaataatgttattttatgcgtacaattttttcaaaatttaaacaatatctggaaagaatatatacagataaatgatatttatgtcataatccgagcaatttcgttttttattttaggagctattatgtcaaaaccattaaattttgtgatgatttctccacattttcctgcaaactttgaaacttttgccgttcgtttaaaggagtgtggttttaatacattaggtattgcagacacaccttatgaacagttaagtgaaaacttgcgtaattccttaacggaatattatcgtgttgataatatggaagactacgagcaagtctatcgtgctgttggttattttgcacataagtatggtcgaattgatcgtattgaatctcataatgaatactggcttgagcttgatgcaaaattacgtacagattttaatgttcccgggtataagaacgatgatatgttggcaatcaaaaccaaagcacaaatgaaagaaatttttcgtcaagcaggtctgaaagttgctcagggaaaagtatttaactctgatgatgaagcacgtaagttagctaaaaaattgaagtttcctgtgattattaagccaaattcaggagtgggtgcaagcgatacttataaaattaagtcggtacaagaattagaggactttttttcttataaaaatgcacacgttgaatacatcatggaagaatttattgatggggacattattacctttgatggtttaaccgataaagagggcaatattgtgttctattccggtcttgaatattccgagtgcgtattggataccgtagaaaatgataatgatatgttctattacgttcctcgagaaatttcaaccgacttaattaaattaggacaaaaatgtgttgatgctttcaacgttcgtgagcgtttcttccattttgagtttttccgtgtgaaaaaaacaggtgatttgatgccgttagaaatcaattgtcgcccacccggtggcttgactattgatatgtggaattatgcaaatgattttgatgtattcagagaatacgccaatattgtgaaagaaaataaattctacacaaatattacacacccatggaatgtggtatatatctcacgtaaagcaaataagaattatgtaaactccattgaagatgtgcaacaaaaatattctactaatattattagtgtgcaaaccgtacccggcgtttttgccaaaattatgggggaacatggtattttagctcgcacagaaactttagatcagatgcatgaaattgcacaatttgcacaacaaaaagcataactttgttttaatttatagacaggatttccctgtctactgtaacttttaggaaaaaaataaatgcactttgaaagacgtagccattggagcggtgaattgggacgtgaaatgcactttaatgtgtatggtcatgcgggtaagcctgtgattgtatttccttcatccggtggaaatcaaaatgaatatggtaactttggtatgattgaagcttgtcgttcttttattgagcgtggcttaattaaattttatacacccgactctttcgataatgaatcttggctggcagaatggaaatccggacatgatatggcacaagcacacaatgcttatgatcgctatattttaaatgaacttgttccactaatccgtcatgaatcaaaatgggacggagcaatgattgcgacaggttgtagtatgggggcattccatacaattaactttgctttgcgtcatccggatttatttgatgttgcaattgcattgagcggtgtttacgacgcacgtttctttactcatgaatatcatggtgattctaccgtttattttaactcgccaattgattatttatggaatcaacatgataactggttcttagaacgttatcgccaaaatcattatattgtggctgttgggcaaggtgcttgggaagaacaacatatagcggatacaaaacgtttagaagaagcatttcgcagtaaaggaatagaaggttggtttgattactggggtcatgatgtggatcatgactggccttggtggcgagttcagatgccatttttcctctcaaaattggaggaacaggggattatttaatcaataaaggaaaacattaaaatctatggagatctcaaaaaaccttactacggtattcatgttccttgtattggtcataatttatatgaaattgcttatcaggcaatcagtttagcggttcgagaaataaatgatagaaacaagatcatttctaaaattgtcattagaagtcggttgatagatagtaataaataaaaaactaaggggaattcagacttaaagaacaaaattagtgatcaaagcctagttaaacccttatcataaatacaagaagttaactaggtcagagacttttaatgcacattgcagtagtaatgatcttcaaaaatacgaccaaaattaaggctaaacaacgttataaatgaaaaagtgagcataaatctgctcactttttgatgctccaactacaattccttatgaattttagaattgtctttgtttatttaatggagtattacttaataatcttagcaacaacacccgcacctacagtacgtccaccttcacgaatcgcaaaacgtaaaccttggtccatcgcaatcgggtgaattaagcttactgtcattttgatgttatcgccaggcatgaccatttcaacaccttccggtaattcaattgtacctgttacgtcagtagtacggaaatagaattgtggacggtaacctttaaagaatggtgtatgacgtcctccttcctcttttgacaacacataaacttctgattcaaagtctgtgtgcggtgtaattgaaccaggtttcgctaatacttgaccacgttcaatttcttcacgttttgttccacgtaataatgctccaatgttttctcccgcacgaccttcgtctaataatttacggaacatttctacacccgtcactgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagacgctaattcaagaattttttcttcccactcagcaactccatttaatgcttgtaatgctgaaccacgtacaattggtgtgtcatcgcccgggaagtcgtattgagaaagtaattcacgtacttccatctcaactaattccaataattcttcgtcatctaccatgtcgcatttgtttaagaatacgatgatgtacggtacacctacctgacgacctaataagatgtgctcacgagtttgtggcattggaccgtctgttgccgctaccactaaaatagctccgtccatttgtgccgcacctgtaatcatattttttacatagtcagcgtgtcccggacagtcaacgtgtgcgtagtgacgtgtcgctgtatcatattcaacgtgtgaagtgttgatagtgataccacgtgctttctcttcyggtgcgttatcaatttggtcaaatgcacgtgcygcaccaccaaagtgtttggataatacagtcgtgattgctgctgttaaagttgttttaccgtggtcaacgtggccgattgtacccacgtttacgtgcggttttgtacgttcaaatttttctttagacacttttcagtttccttttattgagtccccaaaagtgcggtgcaaatttggggagttttgttgattaaataaaattattttttacgtgcttcaattactgcatccgccacgtttttcggtgcttcagcatattttaacggttccattgaatatgatgcacgaccttgagtttgtgaacgtagatccgttgcataaccaaacatctctgctaatggaacttcagcattgattttcacaacaaattcgtttgcttcttgaccgcttaccatagcacgacgacgacttaagtcaccaattacatcaccaacataatcaggtggagtttcaacttccactttcatgattggctcaagtaacactggatttgctttattaaatgccgctttaaatgctagagaagcagcaagcttaaacgccagttcagatgagtcaacatcatggtatgaaccgaaatgtaaacgaacacctaaatcaactacaggatatccagctaatggaccggatttaagttgttcttggatacctttgtcaacagctggaatatattcaccaggaattaccccacctttaatttcgttaacaaattcatatccaggaccttcaggttctagagggtataaatcaataactacatgaccatattgaccacgaccaccagattgttttgcgtgttttccttcaacatcgtttacacgagtgcggatagtttcacgataagatacttgtggtttaccgatatttgcttcgaccttgaattcacgacgcatacggtcaacgataatatccaagtgtaactcacccatacctgaaataatagtttcacctgactcttcatcagtgtgtacacggaaagacggatcttcttgagcaagacgccctaatgcaagacccattttttcctggtcagcttttgtttttggttcaacagcaacagaaataaccggttccgggaattccatacgctcgaggataattggtgcatccattgcacataaagtatcaccggtacctacatctttcagaccgattgcggctgcgatgtctcctgcacgtacttctttaatttcttcacgtttattcgcatgcatttgcacgatacgaccgaaacgctcacgtttgtcttttacagaattcaatacagttgcacccgattcaacaacaccggaatatacacggaagaatgttaaattaccaacgaatgggtcagtagcgattttaaatgccaaagctgcaaacggttcatcatcactggcatgacgctcaccttctgtttcatctggattaatacctttaatggcttcaatatctgttggtgccggtaaataatcaattacagcatcaagcatcgcttgaacacctttatttttgaatgctgatccacaagttacaaggataatttcagtttttaatgcacgtaaacgtaaaccttttttaatttcttcttcagttaactcatcacctgaaaagaatttatccatcaactcatcagaagattcggcagcggcttcaactaagtttgcacgccatttttcacattcagcaagcatctctgcaggaatatcttcataggtaaaagtcatcccttggtctgcttcattccagttgatcgctttcattttaattagatcaacaacacctttgaaattatcttctgcaccaataggcaattgtagaggaacagcattgccacctaaacgtgttttgatttgctcgacaacacgtaagaaattggcaccggtacggtccattttatttacaaaagcgatacgcggtactttatatttattagcttgacgccatactgtttctgattgaggttgaacaccaccaaccgcacagtaaaccattaccgctccatcaagaacacgcattgaacgttctacctcgatagtaaagtctacgtgtcccggagtatcaattacgttaatacgatgttgtggaaattgttgcgacatacccgaccaaaatgccgttgtagccgcagaagtaatagtaataccacgctcttgttcttgttccatccagtccatggttgcagcaccatcatgtacctcaccaattttgtgacttacacctgtatagaacaaaatacgctcagtggtagttgttttacccgcatcaatatgcgcactgataccgatattacggtaaagtgaaataggggttgtacgagccattattatttccttgtttggaataaatttaaaatatgaacaaggctccaccgcatagtaatgtgatgaagcctaaaaaacactttgctactctaccaacggtaatgtgcaaatgctttattagcctcagccatacggtggacatcttcacgttttttcactgccgcacctttgttctcagaagcatctgataactcattagctaaacgcaaagccatagatttatcaccgcgcttacgtgcagcttcaacgatccaacgcatacctaatgcgttacggcgagttggacgaacttcaaccggcacttggtatgtagaaccaccaacacgacgagatttaacctcaactgttggacgtacgttttccaatgcaatttcaaaagcctctaatgcttcttttcctgtacgttgagataacgtttctaatgcaccataaacgatagattcagcgatggattttttaccatctaccattaaaacattaataaatttcgcaagtaattctgagccgaacttcggatcaggaagaatcttgcgaggttcaatacgacgacgacgtggcattgtaatttctccgttttttatcttcaggattatccaaaactctttatgtaagaaatgacatcttacttttactggagtttatggtaattaatttgttaattagcgtttggccttacttaacggagaaccattaagctttaggacgtttaacgccgtatttagaacgactttgtttacgatctttaacgccagcacaatccaatgcaccgcgtactgtgtggtaacgcacacccggtaagtctttcacacgaccaccacggattaacaccacgctgtgttcttgaaggttatgaccttcaccaccgatataagaagttacttcaaaaccgttagttaaacgaatacgacatactttacgtaatgctgagttcggttttttaggtgtagttgtgtacacacgagtacacacgccacgtttctgcggacatgactctaatgcaggaacgttgctttttacaacctttttcacacgcggtttgcgtactagttggttgatagttgccattaataaaactccaatagtttttacaaaaatgtatatttaataatctatctatacaaagatagacgccgaattctaatcacacaaagtgatattgtcaagaattaagcaattctatcctgcaaaaataacgaaagattctatttagattgggtgaagatctatgctttaagtttctcaatagtttttttatcaaagaaataatgtgtaccacaacattcgcattgcatatcaatactaccgccatgttctgttaaaatattttcaatttcatcatcggaaatcaaaagtaatgcagatccagaacgctctaaagaacaaccacaatgaaattccaccgcacttggtggataaatctccacagtttcttcatggtataagcggtacaatagttcttctgcagtcaatccgaataattcttcattttttactgttgcagctaatgtcgcaagatgttcaaaatcctcttgtgaaccggtaccatcaggcatgatttgtaataataatccagcagcaacaggttttctctcatattcaccggaacgaatcaataattgtgtttgtagctgttccgaacgaatgaaataatcctctaagcactctgcaatggttggtttatctaatgcaatcactccttgataacgctccccatttgttggggctatagtaattactaatataccattgccgactaactctgataaggtcatatcatcatacacatcatcttgtaaacgagccaatgcacgaatttgttgactatcactgccgttaactaacaataattttaacggaccgttaccttgaatttgtatggtaatattgcctttgaattttaaagttgctgtcaataaattggtagcgaccatcatttcacctaataaattccgtacaatacgaggatattcatgtgagttaagtgtatcggtgaaagtcttattcaaacgtacccactcacctcgtacggcacgatctttaaataggtaacggtaaagtttgtcattatctgtttgatatatcatatatttttcctgtttattcaaattttcaatatctatcgtctttataaattgaatgctattcctgatacttaaacttcaataaatctctccgctcttttttatttggacggcgatccgggtgtggcatagaaagtgcattattcttacgtgcgattgccattttctctcgctgttcaacactcctagcggtttcacgatacaacaattgtgcttccggtgcaccacgacgttgtgcagatagggctagcacttctacttctttttcttcactaccttgacgcaatttgagtattgcaccaatttccaccgttttatttggtttagtacgttggttattataatgcacctttccaccgtcaatcatttcttttgcaatagtacgtgttttataaaagcgtgcagcccatagccatttatcgagccgaatactatcatctttttccttgggtaaatgctgttttgccatatttgtcttttcgttcagttaaaatcaggggtatgatagggggattaaagacatttgtaaaagggaagattatgaatgaattgaaaagtcgggtattactggacaaggttttacaaattgcttatcaagcaggagactatctcgatcgtttttatgacggaacgtttgactttcagatcaaaacaaaatcggataatacgcccgtcacaaacgcagatttatttgtcaatcaatttctcatcgaaaaattgaccgcacttacaccacatatccctgttttatcggaagaaaactgtcaaattcctttttcacatcgtcgacaatggagtacttattggttgattgatcccctagatggcactcaacaatttatcaatcggacagatcaattcgctgttctcattgcattagttcatcaaaataagagcatattaggtattattcatgctcccgtattaaaacaaacttattatgctctgcaaggtcatggtgcttataagcaaactgaacattatctacaaaccttgtcagccagagagattgacttaaaccacagagtaaaaattgcggtaggttcaaaaagtgcagcacaaaaagtgcggtcagttttgagatcaaattatcaatatgaatttattacttatggttcctgtgggttaaaaaccgcactggttgcagaaggaattgcagactgctatattcggctagggcaaacgggtgaatgggatactgctgcggcacaagttattttacaagaaatagggggaggaatccgtgatacccaattcaacgccctaacttataacaaacgaccgagtttaataaaccctgattttattatggtatcggacatatctgccgattggcaaaaaatcttttaatttaattaatgagaactattggaaatttaaccgttttcagcatattattcttttcttttaaaatcggacttagacaaaatatgaacgtaaacgcagaaagtaattgtattgttatttttggagcttcgggagacttaactcaccgaaaattaatccccgcactttataatctatacaaaataggacgtttgacagaaaatttctctgtgttaggtgtttcccgaactgacttaagcgatgaagaatttcgtgaaaaaatgcgtaatgcgttgagaaaaacagaagatataacagaagaacatttggaaaaattttgttctcatctttattatcaggcgattgatacctcgaatgcttctgattatggaaaacttgttcctcgtttagatgagctacatgatacatatcagaccggaggcaatactctttattatatgtccacaccgccaagcctttacggtgtgattcctgaatgccttgccacacacggactaaatacggaagaatgcggttggaaacgtcttattgtagaaaaaccttttggttatgacataaaaaccgcaaaagaacttgatgtgcaaattcatcgtttttttgaagaacatcaaatttatcgtattgaccattatttgggtaaagaaactgttcaaaaccttctcgtattacgtttttccaacggcttatttgaaccgctatggaaccgcaactttattgactatgtagaaattacaggtgctgaagaaatcggtgttgaagaacgtggcggatactataatgattctggtgcaatgcgtgatatgttccaaaaccacttattacaagttttagccatggtagcaatggagccccctgctattattaatgctgattctatgcgtgacgaagtagcaaaagtgttacattgcttacacccgctcagcgaagacgatataaaaaacaatcttgttttaggtcaatacacatcttcaactatagatggtgaagtggtgaatggttatttacaagaaaaaggtgttccagcagactccaatacagaaacctacattgctttacgttgcgaaattgataactggcgttgggctggtgtgccattctatgtgcgtagcggtaaacggttaccaactcgtgttacggaaattgtcatacactttaaaacaaccccccatccagtcttcagtcaaaatgcaccggaaaataaattaattatccgaattcagcctgatgaagggatttcaatgcgtttcggcttgaaaaaaccgggtgcaggctttgaagcaaaagaagtgtcaatggatttccgctacgctgatttagcaacaccaagcctactaagtgcctatgatcgtttattattagatgccataaaaggcgatgcgacactttttgcacggacagatgcagtacatgcctgctggaaatttgtacaacccatcttgaattataaaaaagatcaagggcgtgtttacgaatatgaagccggaacctggggaccaaccgaagcggataaattaattgctaaaacggggagagtatggcgtaaacctagtggaatgatgaagaaaaaagtctaaatcaaataaatagtaattaaacgtaataacacttgccataaggaatacgaatgaatacaaaaatttttgatacggctcaacatgcagttgaacaaatcgctcaggaatttgtgcaatatagcaaacaaaatcgtgcggtgcatatttccctttcaggaggttcaacgcctaaattgttatttaaaacccttgctcaagagccgtttaaaagcgaagtgcggtgggaaaatttacatttttggtggggagatgatcgtatggttgaaccgaataatcctgaaagtaactacggtgaagtgaaaaaattactgttcgaccacattaggattccaacagagaatattcatcgtattcgtggcgaagaaaacgtagaacaagaacttgcaagattttcgcaagagctgattgcatgtgtaccggatcttactttcgactggattattttaggtatgggagcagatggacatactgcgtcactctttccttatcaaaccgattttagtgattcgaatgtagcggtcatcgcaaaacatcctgaaacggggcaaattcgtatttcaaaaaccgcaaaactaattgaacaggcaaaacgtattacttatttagtcactggtgaagccaaagcggaaattttaaaagaaattcagaccgcacttccagaaaatttaccttatccggcagccaaaattaaagcaaaaaatggcgtaacggagtggtatttggataaagccgccggaaaattattgtcatcttgatctattaattgcttaaatcagtggagcttattatgaaaaaatggttttctgtggtattaattgcgatgctttctgcttgttcgattcaaggaatttttgaaaagcaagatgtttcaacacagtttgaaattgttaaacgccgtgtgattgaaaaacacaaaacctctcaaggcataccagacggtgaattttcaggatctgacagttcatatggacgaacatttaaaacgtttgttaaacatggttatattgataaatactttgatatttaccacccaaatggaaaattacattctcatacggtgttagttgatggtatcgcacaaggttggtcttttggttatactcccgagggcattttacgaacaaaactgttatataaagatggtgcagttatcgaaattattcttttagatgaaaaaggtaatgttattcaacatattaaacaaaaagagggataaattatgtcacaaaaaggtgatatcggcgtgattggactcgccgtgatgggtcaaaatttaattttgaatatgaacgacaacggctttaaagtcgtggcgtataaccgtactacttcaaaagtggatgagtttttagcaggtgcggcgaaaggcacgaacattatcggagcctattcattggaagaacttgccggtaaattggaaaagccacgtaaagtaatgttgatggtacgtgcgggggaagtggtggatcaatttattgaggcattactaccgcacttagaacaaggcgacatcattattgatggcggtaactcaaactatcccgatacaaatcgtcgtgtaaaagccttagctgagaaaggtattcgctttattggctcgggagtttcaggcggtgaagaaggtgctcgccacggaccatctattatgccaggtggcaatgaagaagcatggcaatatgtcaaaccaattttacaagccatttcagccaaaaccgacaaaggcgaaccttgctgtgattgggtaggtaaagaaggttcaggacattttgtgaaaatggtgcataacggtatcgaatatggtgatatgcagttaatttgtgaagcctatcagttcttaaaagatggcttaggtttaagctatgatgaaatgcaacagatctttgctgagtggaagaaaactgagcttgatagctatctaattgatattacaacagatattcttggatataaagatgcggacggcgagccgttagtcgaaaaaattcttgatactgcagggcaaaaaggaacaggtaaatggacagggatcaacgccttagatttcggaattccattaactttaattacagaatcggtatttgctcgctgcgtatcctctttcaaagatcaacgtgtggcggcatctaaactcttcaacaagactatcggcaaagtggaaggcgataaaaacgtttggattgaagctgtgcgtaaagcattattggcatcaaaaatcatttcttatgctcaaggctttatgctcattcgtgaagcctctgaaaacttaggttggaatatcaattacggagcgaccgcacttttatggcgtgaaggttgtattatccgtagccgtttcttaggtaatattcgtgatgcttatgaagccaatccggacctgattttcttagggtcagatccatactttaaaggcattttagaaaatgcgttaagtgattggcgtaaagtggtagcaaaatctattgaggtgggtatcccaatgccttgtatggcaagtgcggttaccttcttagatggttatacttctgagcgtgtgccagcaaacttgttacaagcacaacgtgattactttggtgctcatacctacgaacgcactgacaaacctcgtggcgagtttttccacactaactggacaggacgaggtggcaatactgcatcaacgacttatgatgtataattcaatctcaacacaaaaaagcggtgaactgatcaccgctttttatgtttttaaattaaagaaatagtcaatttatacaagttattcattaattgcatgatttactttgtagttaaggggtaagttgtttacaatgcacaaagattttttattcatcaggattaaaaaatgaaaactgtcaaaaaaagcaaattaattatcactgcactgagtgcaatgttattactttcggcttgtgccactatagatgagcaaaccggagaacgtaaagatcccttagaaggatttaaccgtgtgatgtgggattttaactataacgttgctgatccttatgtgctaaaaccgattgctaagggttggaaagaatatgttccacaaccaatcagaaagggattgactaatgtagcgaacaatcttgatgaacctgccagcatggttaatcgtttgttgcaaggtgagtttaaaaaggcaatggtgcattttcatcgcttttggattaattcaatctttggattaggtggactcatcgactgggcaagttatagtgaacctctgcaaattgaaaataaacaccgtttcggtgatacgctaggtacttatggcatggaaacggggtcttatgtaatgttaccgctttacggaccggcaacacctcgtcaagatctcggcaatcttgttgatgtaacttatccgatgttatccttattaggtccttgggggctactcaaatcgagtatacaacgccttgattctcgtgctaatctgcttggcaaagaaacattattggaacaatcaaaagatccttatgttacattccgtgaggcttatttacagaatgtagatcatcatactcatgatggacaaataaagagaacgcaagaagaattttctaaagaagacttaaaagacatcgactaaactcaagaaggaatttattatggaaatgacctcaactcaacgcttaatcttagccaatcaatatagattaatgggtttattggatccgaccaatacacaaaaataccaacgtttagaagctattgtgaaaggcggtttcggcttagaactgaaagaattggataaagagttttccgatctttcggaagcggaatgtctcactgtattaaatactttggagatgtataacgcattacaaatttcttacaataatttgccggataagtccgctttgacaccgcatcgcttacaatttgcgggctattgtgcagtgcgggagaaaaaatatcttaattacttacgctttatcacctcagtcgaagggaaatatcaagagtttatgcgttgtgaacatggttgcgactcccaaactccaatgtgggataagtacctcaaaatgcttgacgcctggcgtgcctgtccccatgaatatcatttaagcatggcagaaattcaaaaaatcttaaatgcttaattgagtcaacgttggtaaaaaaaccgcactttataaagagtgcggttttttatgtagtttctatcagtaaatttgctacaaccggcggaatacttttggggtgaggaataagaatttgcttatgccgactcagttcacctttttccaaaataatctgactttttgccactttgaaagttttacttaaaaatttcaacaagtgagcatttgcctgtccgtcaatgggtggggcagtaatactgattttcagtgcgttatcatatagtccgataaggtgatctttgcttgctttaggttgcaaaaagatcctcaaacgtaaattatctccaattttttccacagcaggcatacatttctaccgatattgacacgatttaagccaacgcccaataatttcctaataaatcaaacattacacgattgccataaaataaaataaaggcaagtaacatgggagaaaaatcaaccatccctgttctaggtagtaggcgacgaacaggtttgagcaagggttctcccaattgatgtaataaataacttaaagctccacgattaaaccaacttaaaatcgctcctaaaaataaaatatataaaaacaattcaccaaaagttcttaaggtgtgtaataacgcaataattacgctttgtccaatgggaaaacgtgcacccactatcgcaaaaatcatatgatattttaatatgcctaatacaaagacaacaaagagcggtgcaaaattaatattttttattgtcggcaaaactttttgcagaggcaaaataattggattagtgaatttcaccaaagattgtgaaaaaggactataaaaatcaacacggcaatactgaaaccacatacgtaacataaaaagaaaacttaatacgtcaaaaatagtattcaataaaaactgaattgaatttaattgataaatcattataaccatcctttacgtttaaaataccaataaggtgcaaatgctgctaatgccatcagacccaatgccagcggatagccgaacttaaaacctaattccggcatattactaaagttcattccataatttgatgctactaacgttggcggtaaaaaaattaccgatacaacggagaagattttaataatacggttttgttcaatattgataaagcccatagcagcttgcatcaaaaagtttactttttgaaataatgactcattatgcggttgtagggactcaatatcacgcaaaatttctcgagcttgttctaactgattggtaggtaaacgtgttttacgcactaaaaaactcaatgcacgttgagtatccattaaacacaatcgtactttagaactggtatcttcttgttcagtgatagttgctaacgcctgatcaaaagcctcaccttgtttaccttctaaaataatacgactcaatttttccaaatcagcgtacacattttcaattacgtcagctaattgttcaattttagtttcaaataagtctaataacacctcataggcattacattcaactaaacgttgattgcgtgaacgcatacggtataaacgaaatgccggcaattcacgatctcttaaagtaaataatcgcccgtcacgaatggtaaaggcaacgctggctaaatcggcataatcattttcatcttcgcaataaaagaaagagtgtaaatgtaagccatcttcatcttcgaaaaaacgtgcagacgcttcaatatcctctaactctaaaaaagtggctaaattttgcccaagtccttcctgtaacaaatcacgctcttctttactcggctcaagtaaatccaaccaaaccgcattattcaactctttatcagcactttcatcaatacgaaccaaacgagcatcttcgagtgaaaaagcattaatcattttgtcatgctcctctaaagggattatgaacaacgcaatgaacaaaataaaatcaaataagacacgtataaagtgcggtgaaaattatatttgattaaaagatacctgaaaaataggtaatggaacttacctgcgtaatcccgccgataagtgctagaaagacaagacgagatttagaaaaaagataataggtatcgactatgactgtccaaagtgtatgtcctcttgttactaaatcgtgcggaatgttacgcttgaaatagctgttcgtcaaggatttttgcaagaaaaatcccactaaaagcgggatcttataaacaactttcgatttgactactttgtagggtaatcccaccaaatatcgaataattcactgatttcaatttgttgtaaaccgtttttctccaaccagtttttcaccaaagtgcgatgactttcatcacattttcccaatttttccaaacaaactaaaccttcccaatgaagataaccgctaccttcgtaagcaagtccgttttcttgaataacttcacgaataaaacgatcaacgacttcatctacttgctcaatagaggtgttttctgcaaattgccaattcactaaaaagccaagctcttggaattctgctaagtgcatttttttacgttgtctttgattacgtttaatcgccatacttttctcctattgttactattcttgtcaggctgggcaatcatagcatatttatcgcctgttcttaataaaaaaacaaaatccgagcttatattaattatttgttgtgaagtaatgaaaaaaatctttgtatcgcaggggaaataaatttgtctttataaaaaatataattaatccctctttcaaaagttaagttttttaatggaatttcaactaacagttgactattcaattcatgcgttacagccagtcttgaaataaaggaaacccctagattattgattacacaatgtttaattccttctaagctgttaaattccattatttttagttgtgtaatttgttcatggttaaaatgttgaaaaataaattttcttgtttcagaaagattaggtttcatgatgagttgttgctggctaagtgcggtgaaatcacatgctgttttttttgctaaaggatttttaggtgaagcaattaaaatgagctcgtcagataaaaatctatgagtttgataggtttgcggatcaaaataaatttgatctgacataatcaaaaaatcaatttggtgattttctaatttatgaatgagttggggagaaggtaaaatatcaatacttagcttaacgttaggtgatatttttttatattcggcaattattttcgggagcaaataaacacccacaaaatggctggcaccaatagtaatttttccgtagttgggatcatcgtattgatggagatgttctattgaagtttccaatgtagaaagtgtttgctttgcataattttggaaaatcttgccttgttcggttaaataaagtcgattattaattcgctcaaataaaactgtatttaatgactcttcaagttttttaatcttaatacttactgacggttgcgtgcaaaagagtttattcgcagtttctgttacatttaaacattcagaaagtactataaaagctttaagttgacttaaattcatatcaattccataaaaataatttatagcttgtatagaataatacaatttttttatgtttaatcaactctctataatcagattattctatagacaatatatggagtaactcaccatgaatgacacagtaattcaaaatcaagaacaccaatctgcccgaaaagaatggctgaaaaaaatcggtattccgctagctttaactatattgcttgtattgatgtttatgccaacgcctgaggggttaacaatacaagggcaaaaagccattgctattttctgtggtgcgttaactctttgggtctgtggctcaatccctatttatttaacatctttgttagtcattattttattgccattaactcagaccgttgcaaaagataaagttgttttcgctactcttggatatgatgtaatttggttaatggtatctgcttttgtgctaacttcagcaatgattaaatcaaatattgctcgacgttttgctttatggatgatcactcattttggacaaacaccacgtaaggctatgtttgttttggtattaattaattttatattagttttcttcgtaccttctaccactgccagagcttcactcatggtaccaatttgtttaattttactggaaatttatcgtgcggtaccgggtgaaagcaattttggtaaattaatgatgttacaaggtgtgcaagctgatgcaattgcaacatccggtgtaatgacaggaactgccggtaatattattgcggttggatttattaataatcaagctggcggagatattggttatcttgattggcttttggcatctttccccatagcttttgttaccatgataatttctttcttaattggttttaaactgttctcaatgaagaaagaaactcatttttttgaagctttatctcgtcttcaagcagaatataaaaaattaggttctttgactttagatgaaaagaaagctatggcaatctttttgcttacggttctactttgggcaacggaaagttatcaaaaagcatggttcggcttcaaaatcagtgtttatatgaccgctgtgatagcagcagttctctgcttaatgccaagaattggattactcacttggtccgaagccaaaattaaatgggatttaatgctgtttgctgccggtgcttatgcagcaggtaacaccttagaatcgactaaaggtgctcaatggattatggataaagtcgttcatggattaggtttagaaacaatgagccatacggctgtttatgtggtagtaatcttcgtatgtatgtatgtatagccacttgatttttaccagtaaaacggtcaaaacgacaattcttattccatctattattgccttggcacaatctttagggatgaatcctgtaaccttagctttagctgcgtcatttacactgacatatactataacgttacctccacattccaaagtaaacacaatttattttgccactggttattttagtgtgttggatcaaatgaaatacggtttggttacttgctttatcagtgcctcgatcatttgtttatcaatttttacttggttccaattacttggatataccttataaaaaaacggagaggaatcatgcgattaattttattacgtcacggcgaaacgctatggaatcaagaacatcgcctacagggacaccaaaactcgccgttatctgaaaaaggtattcagcaagcgaaagcaattaagcctttgattgagcaattctcacctaaatatgtgatcagttcagatttggggagagcactacaaacagcggaaattattggttataaaaatccaattaaagacagtgagcttagagagttggcaatgggagaatgggaaggttgtagaaaaacggaaataatagctcaacatccagctttatatcaggattggcgtaatggcgattacacaccgaatggggctgagagttggcaagcattttgtcaacgtatttcacaagcactactaaaatgggcaaataaatacgatgacgatattctagctattgttcatagcggtgtaattcgagcagcttgtgaatctttagtatcgctatctactaagcatcttttgcctgtaactcaaggaacattgacgatttttgatatcagtcctaatctacctataaaactggaggcttacaatttggggagttttattcccgccagcaatgtagcggactaaaagattatttattttaaaatctagtaaaaaataaccgcactttatagactctgtttaggatttaaagtgcggtttatttttgttaggatttattttaccctttgcattttatatttttctaagttgcttgaaagcgaatttatttagaaacagttgctttaattagtttttccgctttagctaaactattttccaccgctgaataaggggtcttagagtggctaactacttgttcggcagtatttaataacactttcacttcgccttgttccgcttcggtcaccaacacctttaatggtaattgtaatgcaagactgggatctttaaccatcaatggggtgcctacttttggtgctccgtaaatgattaccgttgcaggttgcattgttaatccagcgtctttagcggctttttgatgatcaatttttgcgaaaatggtcattcctttttttgtgagtgtatctgtaagcacagttatcgtttggtcaaaattgtacttactttcaaaagattgtggttgaagtgcatcgccatgtgccattgcgacttggcttgcgaaaagtattgaaaaaagagctattttcttcataaattacctcgttatgttatgtttttaataaaaaataaatcccaaaccccatgtcctaatttatgtccacgttgttcaaacttggttaaaggtcgaaaatccggacgtgggatatagtcatttgtggcggaagtattacgtaaacctaccgcacttgttaatacctccaacatatattccgcataattttcccagtccgttgccatatgaacaaagccgtttggtaccagtttttgttgaattttttcaacaaagtgcggttgtacaattcggcgtttatgatgttttgttttatgccaaggatcggggaaaaatagttgtaatccggctaaactattgtctgcaatacagtcttgtaagatctcggttgcatcatgacaaataacacgtagattttttacctgcttttcaactgcataagcgatgcaagcacctactcccggcgtatgaacttcaataccaagataatttttatcgggattttgtagagccatttctactaaagatttccccataccaaagccaatctccaaaatcacagggttggtgttgccataaatctgtgtgaaatcaaaagcagttgtttgatactcaagtcctaatgttgcccaattattattcatcatgttacgctgaaattcgcttaaacgtcctgtgcgtaatacaaagctacgaactttgcgtttataacgtccgtcttcagtaaattcagctatttcaacggtctttcttttttgatcggcaaacgtaatcttttgttctgtcatttcatttgactacttgttaatttggggggcaaattataaggggtttaatagaaaatataaagtgcggttaaatttatcaattaagataaagccgcactttttatttgattatgttacacttctttttattttgattacctaaattatgcaggctcaatcctctattaacaatccttttgcttatacggtacttaaatggtatcggcaattcgggcgtaaaaacttaccttggcagcaaaataaaactctatatggtgtttggttatccgaggtgatgttgcaacaaactcaagtagcgacagttattccttactttgaacgttttattaaagtttttccaaatattaccgcacttgccaatgcacctttagatgaagtgctacacttatggacaggactgggttattatgcaagagctcgcaatttgcatagggctgcacaaaccataagagatcagtatcaaggtgaatttccaacggattttcagcacgtgtgggctttacccggtattggacgtagtacagctggggcggttttatcttcagtacttaatcagccttatcctattttggacggtaatgtaaagcgagtgctgactcgttattttcaggtgcaaggttggactggtgataaaaaagtagaggagaagctttggcaattgagtgcggaggttacccctacagagcaggtcgcagattttaatcaagctatgatggacttaggtgcgatggtttgtactcgtacaaaacctaagtgcttgttgtgtccattagccataaagtgcggtgctaatttaaacaataattgggtagattttccgtctaaaaagccgaagaaatcgttacctgagagaaaaagttattttctgattttggagaatcaaggtaaggttggtttagaacaacgccctatttcaggactttggggcggattatattgttttccgcagtttgataccctgactgaattattggcttatctttctcagcaaggtattcaacaatatcaacaatggacggcatttcgtcatacattcagccattttcatttagatatttatccaatttatgcacaaatacaaactgaggaagtggaatttgatcgcacagattggaaaaaaattgcagaaaataacgtagaatattgttctcctatatcaagtgcggtcaaatattggtatgatcctaccaatccaagccaaattggtttggctgtgccggttaaaaatttattgatcgaatttcaaaaaaggaaataattatggcaagaaatgtgttttgcacttacttaaatcaagaggctgaaggattggattttcagctatatcccggcgagttaggtaaacggatttttgacaatatcagtaaacaggcatgggcggaatggatgaaaaaacaaaccatgttagttaatgagaaaaaattaaatatgatgaattccgaacatcgccagttattagaacaagaaatgacaaattttctttttgaagggaaagatgttcatattgagggctatgtgcctccgacagaaaaataatttaacatgaaaaaatatattgtatttgcgattattccttttctttttgcttgtagtagttctaggctaaatgatgactatgatgaagcttttgcaaaagatactcaaggacttgatattttaaccggacaattttctcataatatcgatcaaatttggggagtaaatgaactcctcgtggcaagcagaaaagactatgtaaaatacacagataatttttacactcgcagtcatatcagctttgatgaaggttctattatgattgaaacgttgggtgacaaaagtcgtttatatcattcgattattcatactttattaatgggtgcggatgcaaaaggaatcgatttatttacctctggcgatgtgcccatcagttctcgtccattcctcgtcggattagttgttgatcataaaggtaaacaagttaaaaatattgcgacggcaagtaattttgcaaattatcttttacaaaataagttgcaaacacgttacctcactaatgggaatcctgtacagtatgttattattccaatggttgcaaaccatgttgcagtgcgtgcccaacgctatttacctctaattcgaaaagccgccggacgttatgggatagatgaaagtttaattcttggtattatgcaaacggaatcaagtttcaatccttatgcaattagttatgctaacgcaataggtttaatgcaagttgtacctcatactgcagggcgagatgtattccgtttaaaagggttaaacgggcaaccgtcaaaaaaatatctctttaatcccgctaaaaatattgatacaggtgttgcctatttgactttattacgggataaatatttagatggtataacaaatccaacttcaaaacgttttgcaatgatttccgcttacaatagcggtgccggagcagtactacgagtgtttcataatgatcgagatatagcaattaacaaaattaatcgcttatatccggagcaagtatatcgtattcttactactatgcacccctctgagcaagcaagaaattatttactcaaagtagataaagcacaaaaaagttatagagtgattaagaatagcaaatctgatttgccttaataaaccataacaaaagaataattaagttacgcatgcttaaaagctaagatatacttaactgacttttcattaaacttattcatggagaactgttatgactgccctttttaccactgctcaaaactggctcgctcaagaccctgatgcggaaactcgtgcagaattacaaacattactcaaccaagccaaagcaggcgatatgaatgcacagaaagagttacataaccgttttaacggtcggttgcaattcggtaccgctggtttacgcggtcgcttacaagctggttctatgggtatgaaccgtgtactggtagctcaagcagcgggcggtttggcggaatacctaaaaggctatgatagtgaaccctctatcgtattaggttatgacggtcgtaaaaactctgatgtgttcgtacaagataccgctgaaattatggctggtgcgggcatcaaaaccttccttttgccacgaaaattgccaacacctgtactggcttacgctatcaaatacctcaacactacggcgggcgtgatggtcactgcaagccacaaccctcctgaagataacggctataaagtttatttaggtaaagcgaacggcgggggacaaatcgtctccccagccgatgttgacatcgctaaactgattgacaaagtggctaacggcgatattcgtgacttaccacgtagccaacactacacagtgttagacgatgagatcgtagaggcatatatcgcaaaaactgcctctattgccaaagagccacaagcaaatattaactacgtttacaccgcaatgcacggagtaggctatgaagtgttgagtaaaaccttagcgaaagcaggcttaccacaaccatatttggtcgaagagcaaattcaacctgatggatcattcccaacggtcaatttcccaaatccagaagagaaaggtgcgttagatttagcaattaaactggcaaaagcaaaaaatgccgagttcatcattgccaacgaccctgacgcagaccgtcttgcagttgcggtacctgattcggaaggcaactggaaacctttgcacggtaacgtgattggttgtttcttaggttggtatctagcaaaacaataccacgcacagggcaaacagggcaaattagcttgctcactggtttctagtcctgctctggcggaaattgcgaaaaaatacggtttccaatccgaagaaactttaactggtttcaaatatatcggcaaagtgaacgacttattgttcggctttgaagaagcattgggctacttagtcgatccaaacaaagtacgtgataaagacgggatttcagcagctattgccttcttagatttagtccgtagcctgaaaaaagagggtaaaacactaacagattacgctaatgactttactgcggaattcggtgcatatgtaagcggacaaatctctattcgtgtgaacgaattatcagatatcggcaaaatgatgaccgcacttcgtaaagaaccactaacagaattaggcggtttcgttacacaatttattgatcacagtaaaactgatcgtgctagcgatattctcgtgtttgtgcttgaaaatggtagtcgccttattgttcgtccatccggcaccgagccgaaagtgaagttctacttagatgtgtgcggtacagatccgaaaaatgcagacgaagtattagcggagtttgatgagaacgtacgccaaatcctccgacaagagaagtacggaaaacaggattgctaatttagcataaacacaaaagcacgttttatacctacctgttattttatcgactccatataaaaatcaccgcacttttatctcaataacgaaacaaaagtgcggtagttttacagcaaaatcagataaaattatccctgtgaagaaatacgtttcatgtctgtcatataaccacgcaattcctgaccgattaattcaatcggatgctgacgaattgcatcatttacatcacgtaacaaaatattatcgatttctgttgctggtgttgactcacctaaatcaccacgttttaacgttggaataatttctttagctaaaattggagccgctacgttagcaaataaataattaccatactcagcagtatcagagatgactacattcatttcatataaacgcttacgagcaattgtattggcaattaatggtaactcgtgtagtgattcataataggcagactcttcataaattcccgtttctaccattgtatcaaaagccaattcaacgccagctttaaccattgctaccattaatacgccatgatcgaaatattcttgttcggaaattttaatattttctccttttggtgcattttcaaatgctgttttaccggtttgttcacgccatttcaataaattagcatcaccgtttgcccagtcttccatcatgacacgggaaaattcaccgctaataatatcatccatatgttttttaaatagaaaatccaatttttctttaatttgctcggaaagggaaaatgcacgtaacttagcactattggataaccgatccatcattaaggtaataccgccttgttttaaggcttcagtaattgtttcccaaccatattgaattaatttacccgcatatgccggatctttaccatcagcgattaacttgtcataacatactaaagaaccagcctgtaacataccgcataaaattgtttgctctcccattaaatcggattttacttccgcaacaaaagaagattccaaaacaccagcacgatgtccaccagtcgccgcagcccatgctttagcaatggctaacccttcacctttcggatcgttttcaggatgaacagcaattaacgtcggcacaccgaatccacgtttaaattcttcccgcacttccgtcccaggacacttaggagcgaccattaccacagtgatgtcctgacgaattttttctcccacttcaacaatatttaaaccatgcgaatatcccaaagctgctccttgtttaattaacggcataacatcagcaacgactttagagtgttgtttatctggtgttaaattaatcaccaaatccgccgtaggaattaattgctgataagttcctacaacaaatccgttttcacttgctcgctgaaaagaagcacgtttttcctcaatagcttccggacgaagggcataagcaatatccaaaccggaatctcgcatatttaaaccttgatttaatccttgagcaccacatccgataatgacaatttttttaccttttaagaaattaacgtcatcggcaaattcctcacgatccataaagcgacaacgacctaactggtcaagttgttgacgcaaatttaatgtattgaaataattacccatttccaatctccttatgtaatattccgctggttataaccaaattaaaatttacggtaaaagcattatacataaatttgctattgcgtaaattgactttattgaaaacttttatttcgttttctcaaatagatctgtttttgtttgtaatttatttttttaatttaaagtagtatgaaaaaacagtataattaaggggttagttaattttttcttaacttcttaattttaagaataatttcttttttgggggaataatgagaatatttaaatcaataaaacaattctttgttaagccatctgcaaaaatagggttaggtatccttttggtcggcggtgcctttgtaggaattgtaggttggattatctttaatgccgttcttgaccataccagtcaagaagaattttgtataagctgccattctatgcaatatccattagaagaactcaaacaaaccgctcattggtccaatgataaaggggtttccgcaagttgccctgattgtcatttacctcacaatacggtggataaatatattcgtaagattcaagcaacaaaggaaatttttgccgaattaagcggtaaaatttcttcgaaaacagactttgaaaaacaccgtctagaaatggcagaaagggaatgggcgagaatgtccgctaacggttcggcggaatgtaaagcttgtcacagctatgatcgaatggattttgataaaatgtcggagattgcacgcaatgccatgatacctgcagctgaaaaagatcaaagctgtattgattgccataaaggaattgcacatcatcttcctgaaatgtcacattcatcatcaaaaggcaatggtttaccatcaagctctttacaagcaaataaaatctattatacggaaaataatgtcgctctttttgcagatgaaacaatggggcaagaaatcgggcagttagaaactggtgtaccagtacattttgtgaaaacaacaccaaacgcggatttagttgaactggaaatgtggcgaaaagacaaaggctttggacgaatttggtataaccaattcggaaaaaatattaccgatgccatactaactaaagaatttatgtcggcggagcctaaatatgatgtattggaaagtgttgaagatcctattaccggtctaacttggcaaaaagtaaaactttctgtatggattggtaaaaatcaacttattgaaaatattgataatttatgggctgaagcggaaaaaatttataaaacgcaatgtagtacttgtcatagacaacctgatgtaaaacattttgattcaaatacttggattggactgtttaatggtatggtcggttttactaatattgataaaccaacaggaaaacgtgttttacgctatttgcagatgcattcatctgattttcaaccgcacgataataatcattaatgaggaataaaactatgcaacaatcacgtcgtcaatttttgaaaaatatgtctgttatggctgcgacttttgcaatgcctaacttcctcgttgctaaaagtgcggtggaaaataaacaagatttatcacaatggaaaattaccggctcccattggggtgcaattcgtgccaaagtcgttaatggtcgagtaagtgaaattaaaccttttgagtatgatgaatacccaaccgagatgataaaaggaatcaaagggttaatttatagcgaatctcgcattcgctatccaatgatacgattagattggcttaaaaatagacacaacagcaatacagagcaacgaggagataatcgctttgtacgtgtaacgtgggacgaagcccttgacttattctatgaagagttagaacgaattcaacaaaattacggaccttgggctttgcatacgggtaacgtaggttggcgttcaacaggacaattccacagctgtggtaaccatatgatccgagcaatcggcatgcacggacacagtgtcagtactgccggagattactctaccggtgccggacaaattatcatgccttatgtgttaggctcaacagaggtttattctcaaggaacatcatgggagattttacttaaagagagtcaaaacatcattttttgggcaagcgatccggtaaaaaatttacaggtcggttggaactgtgaaacccatgaagcctataaatatttagcccaactcaaacaaaaagtagcagataattcaattaatgtaatttgtgttgatcctgtgaaaagcaagacgcaaaattatctgggatgtaaacatcaatatatcaatccgcaaactgacgtgccttttatgctcgccatagcatatgtgctttatacggaaaatctttatgataagcagttcctcaaaatgtacactgtaggatttgaaaaattcgtaccttatttaacaggtgagtcagaagataaaacagcaaaaacccctgaatgggcagaaaaaatatgtggtatttctgcaaataaaattcgtgaatttgcacatttactggcaggcaaacgaactcaattgatttttggttgggccattcagcgtcaacaacacggtgagcaaccttactggatgggtgccgtcttagccgcaatgctcggacaaatcggtttaccaggtgggggaatcaattatgcctatcattatagttctatcggtatacctgaatcaggagccgccatgccgggctctttccctttgaacttggatgaaggacaaaaaccgaaatacgaaagcacggattataacggttatagtgcgattattcctgtagctagattatctgattccttattaaatccgggtaaaacaatcgattttaatggacaaaaagtggtttatgctccatataaaatggcaatcttcagtggttgtaaccaatggcatcgtcattctgaacgcaataaaatgaagcaagcttttcaaaaactggaaactatagtatcaattaattacagttggacagccacttgtcgtttttcagatattgtattaccagcctgtacgccttttgaacgtaatgatattgatgtttacggttcatatagtaaccgtggagtcattgctatgcaaaaattagtcgatccgctttacgattctcgttcagattttgaaattttcaaagaattatgtcgcagatttggtaaagagaaagaatattgtcgtaacatggacgaaatggaatgggtagaaaaactttacgaagactgtcgaaaagaaaatgaaggtaaatttgctatgccggcctttgaaaaattctggaaaacaggatttgtactttttccggaaggtaagccttgggtaagacatgcagacttccgagaagatcctgaacttcatgcaattggtacaccatcaggttttattgaaatttatagcaacaaaatcgcttcctacggttatgaagattgtaaaggtcatccaatgtggtttgaaaaaacggaacgttctcatggcggaccaaaatcagataaatttaaattctggttgcaatcagttcaccctgatcaacgtttacattcacaactttgtgaatcaaaagaattacgtgaaacttatactattcagggtagagaacctttatttatcaatccaaatgatgcaaaagaactaggcattgctcatggagatcttgtgcgagtttataatgatcgaggtcaagctattgtaggtgcacacctttcagaggactatccaagcggtgtagtgcggttacaagaaggtgcatggtattcaccgttagatgaaaaaatcggctctattgatacttatggcgatccgaatactatgactcttgacataggttcttctagcttagctcaagctgtttctgccaatacatgccttgttaatattgaaaaatataaaggcattgctcctgaacctaatggtttcaaaggtccaatagaaattgcattatgataacgttgaataccgaagaaaaaatctttatttattcatggcttaaaaatatattaagccatgaattaactgaacagcagctacaacaatatcaacaaggggtttttactcccttgtttgattttttgtcagaacaagatttggcgaagcaaataaatactgttcgaaactcactcatgcaattatctaatttgcctttagctcatttagaattagctgcggattttgcccaacttttcttgttgaatggagaaaatagtgctttgccttacgcctccgcttacttatcggaaaaagaactaaatcaacatattgcatttattgaccatttactatttaaataccagctaaagtttgatcacaatctacgtgaacccagcgatcatctcgctgtttatttagaattactgataacccttgaaaagagcggtcaaaaagagaaaagttttaactttattcaacattatttattagcttggcttattccttttaataaaaaagtacaaaaaattaaaacagaaacctcgttctaccaagccataacagaaatattaatcacgctgttaaataaaaatgtaaaactctcatagcatttaacaaaatcatcaacaaattagtgagtgatttttatgctggatataaaaaagctaatcttaaaagattagcttttactttatttaatttgcctttcaatcacaccgccaccgagacatacctcaccttgataaaaaacagctgattgtcccggcgtaacagcaatttgtggctcatcaaaccgcacttcaatacaatcatcatttataggaataacttcacaagcaacatctttttgacgataacgtgttttgactgtacaacgtaaattttgacgaattggcaagcgatcaatccaatatagctgagtagccattaaaccttgtgataacagggcagaattatcatttccttgtgcaactactagtacattgttaattaaatctttgtctaccacataaaaaggatcttcacttaacccttttactccaccaatacctaatcctttacgttgacctaaggtgtaatacattaagccatcatgtttgccgatgactttaccgtcaaccatgcgaatttcacccggttgagcaggtaaaaatctttccagaaaatccttaaatttacgttctccaataaaacaaattcctgtagaatccttcttttccgccgtaatcaaaccgagatctcctgctatagccctaacaatcggtttttcaatttcacctacgggaaatagactttgtgccacttgatctttgctcaaggtataaaggaaataactttgatctttattactatccagaccacgtaataattttgtttgtccatttacatcggatcgacgaacataatgtcctgttgcaatgtaatcagcacctaaatcttctaccgcatattccaagaaagccttaaatttaatttctttattgcataaaatatcaggatttggtgttcttccggctttatattcagctaaaaaatgctcaaatacattatcccaatactcagcagcaaaattaattttatgtagctttattcctaatttatcacacacagcctgtgcatcagctaaatcgttagcggcagtacaataatccgtatcatcatcttcttcccaattcttcataaacaatccttcaacttgataaccttgctgttgaagaataaaagcggacacagaggaatcaacaccaccggacataccgcaaatcactttctttttactatttttagcaatttcaagtgcggtaagttttggtagttttttttcataaacaatggatttcatatttttatttatttttaataatcaagttaattttttattgaaggtaatttttagataaaaacataaatacgctttcatattgcgaggtgtttacatcaaacatctgtaaaaatctgtcagccgcttttctatctgcaatttctttttgaacaaatcgttcaaaatctttcttcaaactgtgggaaaaagattttctcatattaataaatttgactaataatgtatgagaataataaccttgctgaaaaatatcctttaaaatattgtcctgctcgatcattaatttgttaatattatcaaattgttcttcaataattttcttatcttctgtggaactaattttctctgaaattttccatttctcagccaaaatttcatctaacttaataaaattatactttattttttcagcatccttcactggtgcaataagtgtataacttgaaccatcaatctttatttcctttgggttagtcttcttttctacagcgaaagcaatagaaaaaatttgagaaattacaagtatcaaaaaaagtaattttttcacaaaagcttctccagataaaaaatatcaagaatattaacgttatttcaactcataaaactgcggttgttttttcgcaaatttttcttcatattcagtttttgcatcttcatcaccagcagcaagtttagcctgcaagttatcacatggagtatcacaatcacagacttttttcatccctaaagcagatataccaccacaacttccagcaatggacttacgctttatgatataaccaagagacatacctaaaataactaaaacaaaaatagcaaaagtgactaaaaataatttcatagaaactccttattttttctgagttgataatatttcagcaaatttagaggacattttattttcaaacccttgtggagttttgaccgttaaataaataggtaaatcattttgctcagcaatttccagtgctttttccgcacctaaaacaaataaacctgtggataagccgtctgcagtcatagcacttttagataagactgtaattgaggctaaattatgctgaacgggctggcaagttgtaggatctatttcatgggaaaaacgttttccatcttgctcaaaataattgcgataatccccggaagttgccatagccaaatcttgtaaaccgacaacttgtgatacagatcgagttccatcaaaggttggcttttcaatagctatttgccaagctttattttcagcattatgaccatttgctcgaatctcaccgccaatttccactaagtagtcagtaataccttgctcagcaatataatcagcaactttatcgacaccaaaacctttagcaatagaagataaatcaatataaatctgcggcacagatttggtcaaaaagaatttattgtctttttgtgttagtctaactttctcaatacctacccaggcttttcgttcagctatttgctccggtgtgggtgctttttctacctgtttttccggtccaaacccccataagttcacaataggaccaactgttacatctagagcaccttgagtaatttgatttaactttattgcttcagcaactacaaaagccaaatctgcggaaatttcaataggattatttatctccttgtttttgttgaacacacttaactctgaattaggaatataagtggacattttagcatttacatcttgtaagataccttcaatgccttcgtgcattttttgtactcttaacttagtcttgccattatcaatatatttgatatggtaagttgtacccatggttctaccatttaatgacactaactcagcttctttttggcaagcactaagtaaaaataccaacgcaaatatatttattaaatttaataataatttcttagtcataaagtgcggtttatcctatttataagtttttactaaaggttcatcagcctttttaatatcaatatgacaatagccattaggattttttaataaataatcctgatggtattcttccgctggatcaaatcgttgtaaaggcaacacctcaacaacaattggtttactgtattttttctgttcttgtgtaagagcggttaaaataatttctctatcctgtggatcggtatagtaaatacctgttctatattgtgttcctttatcattaccttgttgatttaaactagtaggatcaattactcggaaataatattgcaaaatatcctctaaacttaatttattttgctcatagatcactttaaccgtttccgcatgaccagtattattgtataacacatcttggtaacttggattttcagttttaccatttgcataacctgaaatagcatccaacacaccatcaatacgatgaaaatagccctctactccccaaaaacaacctcccgcaagataaatagctttgttgctcatacgtaattccctttatgcaagtataattagtttaaataaaatacaaagcggtcagcttcaaaaatttatgaaatctgaccgcactttattgatcatttaagatcagccaccaaaatcatctaataagatattttcatcttcaacaccaagatcttttaacatcttaattaccgcagcattcatcaccggaggtccacacatatagtattcacaatcttccggtgcttcatgatttttcaagtagttttcataaagaacattatgaataaagcctgtgtaaccatcccaatcatcttcaggaagtggatcagaaagagccacatgccatacaaagttatcgttttcggcttgaagcatatcaaaatcttccacatagaacatttcacgtttagaacgagcaccataccaaaatgacattttacgttttgattttaaacgttttaattgatcaaaaatatgtgatctcattggtgccatacccgcacccccaccgataaagaccatctcattatcagtttctttagcaaaaaattcaccaaatggacctgaaatagtaactttatctccttctttcaaagaccaaatgtaagaagacatttgacctggcggtacatcaggattacgtggtggaggtgttgcaatacgaacatttagcattatgatacctttctcttctggatatgaagccatagagtaagcacgaataatatgctcgtccacttttgaagtataacgccataaatcaaatttatcccaatcttcgtggtattcttttggaatatcaaaatctttatagtgaacagtgtgtggttctgcttcaatttggatgtaaccaccagcacggaatggtacttcttcaccttcaggtatttgaagtttaagctctttgataaaagttgccttattgtcattagaaataacagtacattcccattttttcacaccaaaaacttcttctggtaactcaatcttcatactgttcttcacatttacttgacaagaaagacgataaccttctttagcttcacgctttgaaatatgtgaaagttctgtcggcagaatatctcctccaccttcagtaactttcacgatacattgaccacaagaaccaccgcccccacaagcagaggatacaaagatacctttatttgccaatgcacctaataatttaccacctgctggtaagttaatagctttaccaggatcatcattaatttcaatagtaatgtcccctgaatttaccaatttagatttagcaaacaaaataagtacagctaaagctaaaacgataacagtaaacattgcaataccaagagtaatttccatttaagtatcccctattacaactgaacaccggaaaatgacataaacccaagagccattaagccaacagtgatgaaagtaatacctaacccacgaagacctgccggaacatcagcatatttcattttctctgtaataccggcaagagcaactatagctaacatccaaccggtccctgcaccaataccataaacaacagactcggcaaagttatagtcacgctgaaccataaaagataccccaccaaagattgcacagtttaccgtaattaaaggaaggaaaatccctaatgcgttataaagtgcggggaaatatttgtctaaaatcatttcaagaatttgaactaatgcagcaattaccccaatgaaagtgatgaaatttaagaaacttaaatcaacaccatcaattaaagctccatctttaagaatgagagaataaaccaattgatttacaggcacagaaatacctaatacaacagtcaccgcaacacctaaaccaaaagctgttgatactttctttgaaactgcaaggaatgtacacataccaaggaagaaagaaagagccatgttttcgataaatacggattttacgaaaaggctaatataatgttccataaattatttctccacctgttccggtttccatgttctcaggccccaaataatgaaaccgataataaagaatgcacttggtgctaataaaaacaaaccgttggtttgataccacccaccatcttggatagtttggaaaatagtcataccaaataatttacctgaaccaattaattctcgaataaaagcgacagtaactaaaattgctccatagcctaaaccattaccaataccgtcaacaaaactttctattggtgcagatttcattgcaaaagcctccgcacgtcccatcacgatacagtttgtgataatcaaccccacaaaaactgaaagttgttttgataacccataagcatacgcacgtaaaatttgatcaaccaaaattactaacgaagcaataattgccatttggacaattatacgaatactgttcggaatataattacggattaaagaaataaaaaagcttgaaaaagctgtaacaagacttaccgcaattgccataacaactgctgtttcaagtttggttgttaccgccaacgcagaacaaatacctaaaatttgtaatgcaatcggattattatcagtaatcggtgataataataactttttaatatttgcatttgccattagttagcccccttttttagttttgctaaatatggaccaaagccattagcaccaaaccaataatcaaacgtaccttgaactcctttagaagttaatgttgcaccggaaagactatcaattccatgttgtgcatcagacgatgcacctttacctacacgaatagccggttgattttcttcatcaagcagtaatttaccaacaaatttagcttgccattttggattttcaatttcgcctcccaacccaggtgtttcaccatggtcatagaatgtaatacctttaattgtattaccatccggttgaattgaaacaaaaccatacattaccgaccacaaacccgtaccatacacaggtaaaacaatttggtttatctgattgttctcatctttaacaagataaacttccgctaatttagcacgttgacgtaaaccagctttatcatcttgaggggcaatagaaacattttgagcggaatctttcgctgcagattttgcatcaaaaccggtaggacattttacataatcaccagaatttaattccacacaacgagcttcaatattcttagtaaaaatatctttaatttgaccggcttttgtatctttttgcaataatcctgcaacacttaaaatatttttttgcttatcaagttgtttttgttcttcttgtgttggttttaacaataccgcagaaccagcaacaataacagaacaagctaaactcaacagaacaacaatcgaaattgttcctccaacactatctttattaaatttagccattgcgagatctccgacgtttaatatttgcttgaacaacaaggtagtcaaataacggtgcgaataaattagcaaataaaatagccagcatcataccttcaggatatgctggatttgccacacggataattacagccatcacaccaattaatgcaccatataaccatttacctttattagtaaatgcggctgaaacaggatctgttgccataaaaaacatacctaatgcaaaaccgcctaatacaaaatgccaataccattgcattgcaaataatggattagtttcagatccaataatattgaataaagttgaagttgcaatcataccaatcatcacaccagcaatgatccgccaagaagcaattcgagcaaaaacgataattgcagctccaattaataaagcaaaagtagaaacctcacctatagaacctggaatattacctaaaaaagcatccatccaagtaataggctcgcctgttgcaacatgttttaatgcaacttgtccacctgcagcccattgagaaagtgcggtcgcaccagagaagctatccgcagctgtccaaaccaagtctccagaaatttgagccgggtaagcaaaaaataaaaacgctcgacctgctaatgctggattcatgaaattcttaccaacaccgccaaacacttcttttgcaacgacaacaccaaaggttgttgccaatgccgcttgccataatggtaatgtagggggaacaatcaatgctaataaaatagatgtaacaaagaaaccttcattaatttcatgtttacgcaccattgcaaataaaacttcccaaaatccaccgaccaaaaagacagttatgtaaattggtaaaaagaaaattgcacctaatgccattttagctaaaacaccagcatcaatagacactaaaccaagcatgtttgctaatgcaaagtgccaatcattagctacattttgagctaagtttgcagaaaaatcaccaacacttaatgcaagaattgattgtgcaccaacattgtacattccgtaaaacattgcagggaataatgcaagccaaacaagcaccatcatacgttttgagtccaatgcatcacgaacatgtgaagatttacctgttactgtacccggcgtatataaaaatgtcgctgtcgcttcgaacaatgcataccatttttcatatttaccacccggcaaaaaagcaggttccattttctctaaaagatgttttaaacccatttttaaccttccttctcgatcttatctaatgctgcacgtaacatcggaccatattcatttttacccggacaaacgaaagtacataaagccaaatcttcttcatccaattcaagacagcctaaagcctgtgcactatccgtatcacctgatgctaaatcacgtaataataatgtaggtataatatctagaggaacaacacgctcatatgcaccaatcggtaccatagcacgatgaccaccatttactgcggaagtaaaattaaataatttactgctgaaatgtcctagtactgttcgagtaatggaaaatttgttttttcctggcataatccagcctaaaaattctttctcacgaccttcagcaataacagatacttgcaaagcataacgtcccaaatagttatatggaccgattgctgtattaccacttaacactgaaccagaaataactcgattttcacccgcacttaattcattttccgttaaatgtgaaagatttgcacctaactgcgtacgaattaaacgaggatttttaacttgtggtccagctaaagaaaccactcggtcagtataaatttcgcctgtagtaaataatttaccaatagctataacatcttgataattcaaataccaaactgatttagttgcactaacaggatcaataaaatgtatatgtgtaccacttaatcctgctggatgtggtccactaaaatcatgaacagctaagttaggtaaatcaatcgttgggatattgctatcaccagctttacacaaatgtaatttgccttcatgtaaacgacttaaaacggttaatccatcagtaaaatcctgccaatgttcttttaaaacaatttcaggatttgctgataatggatttgtatccattgcattaacaaaaatagaagaaggtactgcatcactcgcaggtactttactgaaaggacgcgtacgaagtgcggtccataaaccagaagattgtaaattttgacgaacttggtctgaagtcaattttttcaattcatcttcattatattgagtaaaggtaatttgttcattaccttccactttaattaccacagattgtaaaactcgcttagcaccacgattgatcgcagttacagtaccacttgcaggtgcagtaaatacaataccaggattttttttgtcttcaaaaagtacctgaccttttttcactacatcaccttcacgcaccttcatcgaaggtcgcatacccacatactcttcgccaagcaaagcaacttctttaacagtattaccgttatggattacttgttctggttttcctgcaataggaatatccaagccttttttaattgtaatcatattgtttgcactacttttcgttagattaaaatatagttgtaacaaaaaagtaacaaccgcgtcttgagtaatgatttcagccgacgaactactaaaaatcaatttatccgcttcaatcacataaaaataaaactcaaattctgttttttactgtacctagcttaatgatagaaacaataaattaaaaatttactaaaaatcaacgagtcattttaactaaataatgactccgattccactttagacacctttttttatgtttttttatgaaatttttgatctatttttgtaaaaaaatcaattctaaaccaaaatattgctaaagagttactgaccaatacctgaacaattaggtgactttggaaaaactttgcctaatttttcccattcttcaggactatataaatgtaaagctaaagcatgaataccttgttgtaactcactactaaacaatgagtaaactaaacgatgacgagcgacttttgtcaaggatgaaaacctattgctcacaacaactaatttaaaatgagagttagcacctcgacctgagctgtgcatataactttcattttctatctgtaaaaagtgcggtgaaaattcttgtaatagctttttttctaggactttttgtatcgacataagtttatccttatttttactatttgatatttgatgtataacactatattttcattaataaaaaacagattttatttttatcttacatcaaaaatagaattttttattactcaactctgtttttttattgcatactctttcattacatcaacaaaaaaccgccttttggcggttttttatttataagattaacgttttctttgtgttaaacgatctgttaattcataagcacgtaattttgccaattctcttgaaagtttagataccaacatttcataattagcatctttggcaccagaaacaatattttgttcagccttacgtttcgcctccaaaatacgttctctatcaagttccttaccacgaatagcaacatcagctaaaacagttacaactgttggttgaacctccaaaaaacctcctgaaatgtaaataacttcctcagtatcatcttcaagagtaatttttataatacccggcttgatagcggtaagtaagggtaaatgtccggctaaaatacccaactcaccttcagaacctgtagcttgaatgcctttaacttcaccattaaaaatatgttgttctgcacttactacgattaatttaaatgtcgccatctttttctccttcaagtttgctgttaatcagtcttgaagtaactacatttttttggctttttctagcacttcttcgattgagccaaccatatagaacgcttgttctggtatatgatcgtattcaccatctaaaatacctttgaaaccacgaatagtatcttttagtgatacatatttaccaggagaaccagtaaatacttctgcaacgaagaacggttgtgacaagaaacgttctattttacgtgctcgtgctaccactagtttatcatcttcggaaagctcatccataccgaggatagcaataatatcctttaattctttatagcgttgcaaaataccctgcacacctcgagctacatcataatgttcctgtcctactaccaatggatctaattgacgtgaagtagaatccaaaggatcaacagctggataaatacccaaagaagctatattacgacttaacaccactgttgaatccaaatgagcaaaggttgttgccggagaagggtctgtcaagtcatccgccggaacataaacagcctgaacggaagtaatagaacccgtttttgttgaagtaatacgctcttgtaaaacacccatttcttctgctaatgtcggttgataacctaccgcagaaggcatacgacctaaaagagcggatacttctgtgcctgccaaggtataacgatagatattatctacgaaaaataatacatcacgaccttcatcacggaatttttccgccatagtcaatcctgttaaagcaacacgtaaacggttacccggcggttcattcatttgaccataaaccaacgatactttatctaatacattagattctgtcatttcatggtagaaatcattaccctctcgagtacgctcacctacacctgcaaatactgaataacctgaatgttcgattgcaatattacggattaattccatcatatttacagttttacctacaccggcaccaccaaataaaccaactttaccacctttagcaaaaggacaaattaggtcaataactttgatacctgtttctaaaagttctgtactatttgattgttcttcatagcttggtgcagcacgatgtatagcccaatattcttccgcaccaatttctcctttttcatcaataggctctcccagaacgttcataatacgtcctagtgtttttgttcccacaggaacagaaattggatttcctgtattttctacttttaaaccacgttttagaccatcagatgaacccaatgcgatacaacgtactacaccgccacccaattgttgttgaacttcaagagttaatcctgattcaacttttaatgcatcataaacttttggtactgaattttgtgggaattcaacatcaattaccgcaccgataatctgtataatttttcctgctgacattaccttatctccattaaattgctgctgcacccgcaacaatttcattcaattcatttgtaatacttgcttgacgagctttgttatacaccaactgcaagtcattaattaaattacctgcattatctgttgctgctttcattgctaccattctagccgcctgctcagaagccaaattttcaacaaccgcttgataaacttgagattccaaataacggactaataaactatccaacaaagtttgaggatttggttcgtaaatgtattcccaattatcactatttttgcctaagctatcattatctaattccggtaatggaacgagtttttccattattggtttttgcgacatcgtattgatgaacttattataagtaacatagattgcatcaattttaccttctttataagcctcaaacatacgatttgctataccaattaattcttcagctacaggggtatctcccatacctgaatgctgagctttaatatttaaaccaagagattggaaaaaacctataccttttgctccaattaaacctaatgaaacatcaacattttgttctttccagttttttatttcagaaagtgcggtcttaaataaattaacatttaaaccgccacataaacctctatcggttgaaataattaagatgccaacgtttttaacttctcgttcaatcaaaaatggatgttgataatcaatattggcttttgatatatggctaattacaccttgtattgctttagaatacggacgtgaagacgacatacgatcttgcgttttacgcattttcgatgctgcaaccatttccattgctttagtaattttttgcgtactttgcacactggatattttggttcttatctcttttgcaccagccattttatttctccgttaattaactattaccatgtaacatttgctttaaattgatctaaaacggtcttcaatgtatttttaatttcatcatcataattaccagttttagtcaactcagccataaattcagcatagttgtagtttgcatattctaaaagtgcggtttcaaaagtacctatacgatttaattcaacgtcatctaaataaccaaattcaacagcaaataataccagagcctgttcagcaacacttaacggtgaatactgtttctgtttcaataattcagttactttttgtccatgtgataattgtttacgtgtagcttcatcgagatctgatgcaaattgagcaaaggcagctaattcacgatattgagcaagtgcggtacgaataccaccagccaattttttaactactttggtttgtgccgcaccacctacacgagaaaccgaaatacccggattcactgcgggacgaatacccgaattaaataaattggattccaagaaaatctgaccatccgtaattgaaattacattagttgggacaaacgctgaaacatctcctgcttgagtttcaataataggaagagcggttaaagaacctgtttttcctttcacttcaccttttgtgaatttttctacatattcttcactcacacgagaagctcgttcaagtaaacgagaatgaagatagaacacatctcccggaaaagcttcccgacccggtggacgacgtaaaagtaatgaaatttgacggtaagcaactgcttgtttagataaatcatcgtaaacaattaacgcatcttcaccacgatcacggaaatattcacccattgcacaacctgaatatggagcaaggtattgtaaagctgctgattcagatgcagaagctacaacaacaatagtattttgtaatgctccatgttcttctaatttacgtactacgttagcaattgttgatgctttttgaccaatagcgacatatatacattttatacctgaatcacgctgattaatgatggcatcaatagccaatgctgttttacctgtttgacggtcaccgataattaattcacgttgaccacgaccaataggaaccattgagtcaacagccttataaccagtttgtacaggttgatcaacagatttacgttcaattacacccggtgcgataacttctaccggtgaaaaaccatcatttttgatttcacctttaccatcaattggctgtccaagggtatttactactctacctaataaacctcgaccgaccggtacttcaagaatacgacctgtacactgaacttccataccttccgctaaatcagagtaaggtcccatcactaccgcacctacagaatcacgttcaaggttaagtgccatggcataacgattacccggtaatgcaatcatttctccttgcatcacatcacttaaaccatgtatacgaataattccgtcacttacagaaacaattgtccctgtattacgtgcttcgtttatcacctcaaactgagctatacgttttttaatcaattcactaatttctgtcgaatttagttgcatattttattcctcttacaatcgcaactcatttgctagacggttgatttgtccacgacaactaccatcaataacaaaatcatttgtacgaataatagctcctgcaattaacgaactatctattctgcaatttaatattactttacgagcaagtcttttttccattgcggtaataattttctgttgctgtgcatcatttaactgttgagcagaaataacttcaacttgtgatagagatttatattcttcaacataagatttaaactcgttaaatacagctggaagtacagctaaacgcttattttcagccatcaacctaactaaattttgcccatattgatcaagttgttcgccacaaattgagataacagtatcagtaagtttaaaagtagaactagtgcttgttaaataagtttgaactttatcatgacgaataagctcagacaaaaactccaacatattagtccatttttctaccgcacttttatctttttcagactgctctactgcaaaatcaaataccgctttcgcataggggcgagctatcgtagttaattccgacatagtctcaaccttcctataaatctgcaactaatttatcaataatgtcattgttcgccgcttcatcaatgttgcgacccacaattttctcagcaccggcaatagcgagagatgcgactttaatacgcaactcttcttgaacacgtttacgttcagattctatttctgcatgtccctgttcaataattttctctcttaatgcctcagcttcaattttgacttcttccaaaatttcattgcgacgtttattcgctagatccactatttcctgagctttaattctagcttgattaatttcttgctcaactaaaacctttgtatcggattgctcttttttagcagcttcagccgaagctagtgcatttgcaatagatctttgacgttcttctatagctttaataatcggtggccatacatatttcatacagaaccacacaaaaatagcaaaagcaatcagctgacctattaatgttgcatttaagttcacaatgccctccctaaaattggatttattcttctaaagaataatatgattatttatccaactttaattagtttaataaaccaatgaatggatttgcaaaaataaatagtaatgcaatacctactgcaatcattgaaatagcatctaaaagaccagctacaataaacatttttgtttgcaagctagctgctaattcaggttgacgagcagatgattctaagaatttaccgcctaaaagactaaaacctatagcagtaccaagtgcagcagctgctaataaaattacagaaccaaaaatagttgcagtaataatgttttccataatattctcctatagatgtagataaaagtttagccaaaagctaagttgttaaaaaatcaatcgaaaatgtttagtaaaaataatttcataaaacagatttaatgatctgatttattataagctatacttagatatactacagtcagcatcataaaaataaatgcctgtaaagtaataactagaatatgaaaaatagcccaaattaaatgcaaaggaatacctaatacttgcggaataatattatctgccatatacataacagcaataaggacaaaaataagctcccctgcgtacatattaccgaataaacggaaagctaatgaaataggcttagccaaaagggtgactgcttccaataaaaagtttacaggaataaatgcccaatgattgaatggatgtaaggtatattcttttacaaaaccgcctaaccctttagacttaatcgtgtaaaaaataattaatgcaaacacacaaacagacatacctaatgtcgcactaatatcggctgtaggaactgctcgtaaataatgaatacctaataactcggcaaattgcggtggaaaatcaacaggaatcaaatcaatagcattcataataaacacccaacagaatattgttaatgccaatgatccaatttgatgacgaacatcacttccgtgaatattatctttaacaacaccatcaacccactcaactagcatttcaactaaacattgaaattttccaggaactcctgatgttgctttactagcaatacgatagaaaaagaaaaggaacaaaactccagatactaaagaaaaaaataaagtatcaagatggacattccaaaaaccttgtccggtagttaagaatgttaaatggtgactaatatagtcagcagtagtatggccagccatagttaatcctttttaaaactaaattttaaggcatttatttaccataaaaggcaaaagattattcaatacaatacttataagataacctacaaaaaaaactttaaaatcaaccttaaatgttttaaaaatgaatacaaccaaaataattgttaagataaacttaatcaattctccactgtaaaacatttttaggttatttttatactttttgttagtaaaaaacattaaatacacaaaaaggcaatatggaataaaaactgaaagtgcaccaaataagaaagataagtacacttcatgatcactcataccgcctatactcagtaaagcaaaagaaaacataaaaataaaaaactcaattaataatgaaattttatatcttttttgagttttttttattacagcagacatcttatcgttctaatttgctacttacaaaaatcttgccagttacaagcctatttttgcgaatttttaacttaaaatcattttataaatgacagtttcgaccatattataaataattcattaaatttattctaatcttttttaacaaaactaaatgacgcttaccaactaattcaggaacattcaattctatgattttatccacagaaaattgagcagataaagccgaaacttcttccatattatattgaccttttaaagcataaaaaaaaccttgatccgttagtaaatgttgacaccattccgtcatatcttttaaagatgcaaaagctctacttaaaaccccatcaaattgatgatcaggtttaaattcctcaactcgacttaaaacaggttcaacattagttaattcaagttcacgaactgcattacgaatgaaactaatacgtttaccgagactatccaataaaaaaaactttttgtcagggttaattatagctaaaggtaatccaggtaatcctgggccagttccaacatcaataaaaatatttccttgtaaataaggacttacaacaatactatccaaaatatgttttaccaacatttccatgggatcacgcacagatgttaggttataagccttattccatttgtttaataataaaaccagctgaactaaccgctctttttgtaaattagtgggtaaaagagcggtattttttaacaaaaaatttagtttttccattaaattcttttgtaaatcagccattattcacctcgtttcagcataccttgtttttttaaattaacgagtaaaatagaaatagctgcaggcgtaatacctgaaattcgactcgcttgaccaatagaaattgggcggtattgttccagcttagcacaaacttcattggataatcccgatatatttttataatcaaaattagcaggaatagccgtattttcatggcgtttttgacgctcaatttcttcttgttgatgttcaatataaccttgatatttaattgcaatttcaacttgttcaacagcttctttgtcttccattgccggtttaaaaggagtaagtgcggtcaaaatttgataatttatttcaggacgacgtaataaatcttccccatttacttcacggacaagtgggctttttaatatttcattagcctcatttaaatattcagaacgaggatgcaaccagattgaacgtaaacgttgacgttccagttcaatattttccattttttgattaaatcttgcccagcgaatatcatcaattaatcctaattctcttgcaattgaagttaaacgaatatcagcattatcttcacgcaacaataagcgatattctgctcttgaagtaaatactctataaggttctttagttcctacagtacaaagatcatcaaccaaaacacctatataggcttgatctctacgaggaaaccaactttctttttcttgaacaaataaacctgcattaataccagctaataaaccctgtgcagcagcttcttcatagcccgttgtaccattaatttgaccagcaaaaaataaaccaaaaatagcttttgtttccaaagttggttttaagtctcttggatcaaaataatcatattcaattgcataacctggtttaacaattcttgctttctctaatcctttcattgaattaacaattttcatttgaacatcaaacggcaaacttgttgaaataccatttggataaacttcattacttgttaaaccttccggttctaaataaatttgatgagaattacgatcagaaaaacgtattactttatcttcaatagatgggcaatagcgtggtccaataccttcaataactcctgtatacataggactacgatctaaatttttgcgaatcacatcatgcgtttgatcattggtatgagttatatagcaaggaatttgctccggatgttgttctacagatcccataaaagaaaaaacaggtaatttttcatcgccatattgtttagctagaatatcaaaattaatagtacgagcatcgatcctcggcggcgttcctgtttttaagcgatttactcttaaatttagatccctaagttttttagcaagatttacagatgcaggatcacctgctcgaccaccagcatagttttctaatcctatatggatcttaccggctaaaaatgtacctgcagttaatactactgactttgccctaaattttaatcccatttttgtttcaacacctgcaatactatctttttctaaaataatatcggttacttcttgttgaaaaatatctagattaggttgattttcaagagcaatacgtacaacttggcggtaaagaacacgatctgcttgagctcgtgtagctctcacagcaggacctttgctactatttaaagtgcgaaattggatacctgctttatctgcagcagttgccattaatccgcccatagcatcaatttcttttactaaatgtcccttacctattccaccaatagccggattacaagacatttgtcctaaagtatctatattatgagttaataaaagcgtttttagtttcatacgagctgtcgctaaagcagcttctgttcccgcatgcccaccaccgattacaatgacatcgtaattttctgtataaaacataatagtctaagtgttattaaaggttttagagttcaaaatagcgatctattctacattaaattacaagataaacaaaaagaagaaagaagtaaaagatcatcagttgatcttcttcttaatataaatagaatctttttatatataaaagtattattatgtatattattaggatctttttttttgttaataagtgtttttttattttttaaaataataagttggatcttttttttattgttatgatctagatcgtttacagtaaaaaatctgtggatatttttatattttatccacaaattttttttaataaaaaacttttttatcttaataacaggaaattttttgttttttattaaagttatccacagagtaatgtaaattaattgaataaatttagattaacattttttaaccagttttcagcaaaatgatcaggatcatcaacattaatgacatctatttttaaactttctgtaatttttacagcttttttattcagtaaaatgtcttcaatttgattcacagcatagcaaaaagtatcataatcggagcttcctaaaccaataacagcaaaacgtatttgagaaagatctaagtttttttgtgtaatttcttcaaataggggttttaagttatcaggtagttcaccggaaccatgtgttgaacttactattaaccaatttttatgtttaattacatcatttagtgaagggccatgtaatagattagtcgatatacctttcttatctagtaagaattgaatatgttcggctacatattctgcacctcctaaagtacttcctgttagaatgcaaatttgtttattcatcttaataccttaattttagttaaaaaaataggcttagaattaatctaagccattgattttatgaatttaaatattatcaatacgacctaataatgaacgtaatcgttcttgccagttatgatgttctgtttttaagtgttcattttcgctacgtaattgctcattggtttgacgagatagctcatttttttcttttaattcttcaatttctaattgaagtaattggattgtttcaacagcttgtttaattttttcttctagttggtctaaaatttctaaagacatgatggtttccttttaaataaaactaatttgtgtagttattctaactcagttgtctattatttttaaggaaatttatgaaaaatttgcatgttgtatggcattgtgcaatcaatccattatttgtaatagaaaatataccgctctttatgttttattggagtataacatcagcagtaagttgataaaaattagcctattaagcaaatttttgctataatccgagccagtttttatttataaaaaagagaaattttatgtcagaaaatacaactgaaaattatggtgcaggaagcattaaagttttaaaagggcttgaagcagtacgtacacgacctggaatgtatattggtgatactgatgacggtacaggcttacaccatatggtttttgaagttgtagataatgcaattgatgaagctttagcaggttattgtaaagatattattgttactattcatgcagataactctgtctctgtgcaagatgatggacgtggtattcctgttgatattcatcctgaagaaggtgtttcagcagcacaggttattatgacagtattgcatgctggtggaaaatttgatgataactcctacaaagtttcaggaggattgcatggagtagggatttctgttgtgaatgccttgtcggataaattacaactcactattcgccgtcaaggaaaagtgcatgaacaattttaccatttaggtgatccacaggaacctttatccgttattggtgaaacggaaaaaacaggtacaactgtacgcttttggcctagtcccactatttttactaatattgattttgaatacgaaattttggcaaaacgtttacgtgaactttcatttttaaattcaggtgtatcaataaaattattggataagcggaataatcgtcaagatcattttcactacgagggcggtattaaggcttttgttgaatacttaaataaaaataagacaccaattcatcaaaaaatattttattttagtgcggaaaaagacgatattggtgtagaagtagctttacagtggaatgatagttatcaagaaaatgtttattgtttcactaataatattccacaacgagacggaggtactcatttagccggttttcgtggtgcattaactaggattttaaacaaatatgtagaagaaaattcgaataaaaaagacaaaaaggatatagcaacttcaggtgatgatgcgagagaagggttggttgctattgtttctgttaaagtaccagatccaaaattttcttcacaaacaaaagataaacttgtgtcttctgaagtaagagctccagtcgagtctgttatgagtgattatttacaagaatttttggaagaaaatccaaatgatgccaaaattattgtaatgaaaattattgaagctgctcgggcaagagaagccgctcgcaaagctcgtgaaatgacacgtagaaaaggtgctttggatatagcaggtcttccaggaaaattagctgattgtcaggaacgtgatcctgctttatctgaattatatcttgtagagggtgattcagcgggaggttctgctaaacaaggacgtaatcgtcaaaatcaggctattttgccattaaaaggaaaaatacttaatgtagaaaaagctcgatttgataaaatgttatcttcccaagaagtgggaactttaataaccgcacttggttgtggtataggcagagatgaatataatcctgataaattacgttatcatagtattattattatgaccgatgcagatgtagatggttcccatattcgtacattgttattgactttcttttatcgtcaattgccggaattaattgaacgtggtcatgtttatattgcacaacctcctttatataaagtgaaaaaaggtaaacaagagcaatacattaaagatgatgaagaaatgcaacagtttgagttaaatttggcattggaaggatcatctctttatgtaaatgaaaatgctccggcaatgaacggaatagcattagaaaaacttatttcggaatataattcagtacaaaagatgattagccgtttatcttttcattatccagaaatattattgaaatcattaatttatcaaaacgcattaactaatgaaataatggctgatgaaagtgcggttgatttttgggctaaatctttagttaatattttaactgacaaaaaaataagcggtagtagttacaaatatcgtattgtatttaacaatgaacgtcatttatatgaagtagttatcattattcgtacccatggtatagaaaaaaattattttttgaattttgaatttttaaatggaactgaatatagccgtattgttaaattaggtaaccaactacagggtttattagaaaaaggagcttatgtatctcgtggtgaacgtcaacaatcggtttcgtcttttgaacaagctatcgaatggctgacaaaagaatctcgccgaggtctgattattcaacgctataaagggctaggagaaatgaattcagatcagttatttgaaacaactatggatccaaataagcgtacaatgttaaaagtatcgattaaagatgctgttgcagcggatcaattatttaccactttaatgggagatgaagtagaacctcgacgtgaatttattgaaatgaatgcactaagagctaatttagatatttaattttattttttatttatcaattttggaattaatagaggtttttgatgtgtacagttatgcagaaagaagtattaattgaaatgattgctaatactatggctacgatcaatgtaataacagaacctaaagcagaaaataatgaggatcagaattatttgatgaacttaagaaatgatttgtatagtactcatcatgatgacattgattataatctcttatcaatgacagtaaagaatatcaaagataaatatataggtttgcctgttcataaatattatgcgtaggtgataagcataataaataatctcttgatttgtatgaatattatttgtaaataaaaagatccccttaaaaagggggatttttatttttttgttgttctaaaaaattgatgttctttaattaacgcaagaaagggttgagcaaaacgttttaatttaatatcgccgacaccattaatttgtatcatttcttgttctgttattggttggtattgtgccatttcttgtaatgttgcatcgttaaatactatataagggggaatattttctttgtctgctatttttttacgcaaaaaacgtaatcgagcaaagagatctttatcgtaatttgtgaccgctctttttggtatagtaacggcattagcaatagaggatattcttggtgttgctaattgcaatggttgttcacctcgtaaaataggtaatgcctctaatgtgagttgtaatgttatattaaaatggtcaattacttgttttatcagacctaaatggattaattgtcgaataactgattgccaatattctctactacgatctttaccaatgccgaaaacgcttagtttatcatgttgatattctttaattttttgattttgggaaccacgcagtacagcaataatatacactgccccgaaacgttgccccactcgatagattgctgacattactttttgtgcatcaaccaatccatcatattttttcggaggatctaaacaaatatcacagttattacaaggtttttgttgatattcgccaaagtaatttaatagaactaaacgccgacaaatttggctttcagcaaattcccctatggattgtaatttatgtagttctatttgacgttgcggtatatctggtttttctaaaagtactttttgtaaccaagcgtaatctgcaggttcgtaaaataagacagcttcagctggtaaatcatctcgccccgctcgtcctgtttcctgatagtatgcctcgatacttcgaggtagatcaaaatgagcgacgaaacgcacgttagatttattaattcccattccaaaagcaattgttgcaacaacaatttgtacattatcatgttgaaaagcacgttgaacaaattctcgttgctcattactcataccagcatgataagcttcagctgatattcctttttggcgtagactttctgcaattcgttcaaccttattacgactattacaataaataattccatttttccctttttgttttgcgataaattgagaaagttgctccataggtttaaatttttcaactaaggagtaacgaatatttggacgatcaaaactaccgatataaatatggggattagataatttaagatgaataaggatatcttgtcgggttgcctgatctgctgttgcagttagtgccattattggtgcatcaggaaaacttgctttcaatcctcctaattgagtatattctgggcgaaaatcgtgtccccactgtgaaatacaatgggtttcatcaacggcaataaaactgactttgcaatgagaaataaaatgaaaaaagctggttgttaaggctttttctggagatatataaagcaactttaattttcctgacattgctttattttgaaccaactgttgttgttcaaatgtttgactggaatttaaataatcagcatttataccatttgctaataactgatctacttggtctttcattaatgaaattagaggagaaatcactaaagttaaaccggagaaacaaagagcgggaatttgatagcataaggactttccgccacctgttgccataataactaaactgtcctttttagctaaagttgcttcgataacttccagttgtcctttacggaaggactgatacccaaaaacagaatgtaaaatatcaagtgcggtagatttttccacagaatcttggctaaaatctactgcacttttttgttgcttccattcttcaactgacattaagaaaaactcacctgttcaccatgagccaaacaagcttgttctaaacattgccaaaacaattttccatcctgagcaatccattgattatttttaaaggcaaaatgaaaacctccagccttgcttgcaagccataattctaataatggttcttgtttatttacaacaatttggctacgatcaacgaaagtaatagtaaaaaccgaaccttgagtatcacagtctacatcacaaccttgttcttctaattgttcttctatttgcaaccaaacttgttcgatattttggtgatattctgctatgttcataaagtttacctattaataaaaaagaataacaaaagattataaatatttttataagatagtgatagcacaaaggcatttttaatggtaaaaagtgcaagttttttaattaacaaggacataagcaatgaaaaaaataatttcaattttattacttagtgcaatagcttttggtgtgtcaggttgtggtgttaaaggatcattatattttccagaaacagaacaaaatcaacaaaaagttaattcaaaattaaagtaatcaatatgtaaggataacattatggatttttttctatataaagatggacacttaatggcagaaaatgtctctgtgaaaaaaattgcagagcaatttggcacgcctgcttatatttattcacgagcaactctagagcgtcattggcatgcttttgataatgctttaggagatcaccctcatttaatttgttttgctgttaaatccaatcctaatatagccattttaaatattatggcaaagttgggatcaggttttgatattgtgtctcaaggtgaacttgagcgagtattatttgctggaggtgatcctaaaaaagtggttttttctggtgtggcaaaatcagaacaagaaattgcacgtgcattggaagtaggtattcgctgttttaatgtggaaagtgcggctgaattaataagaataaatcaggttgcaagaaaaatggggaaaattgcctctatttctttgcgagtaaatcctgatgttgatgctcatactcatccttatatttcgactggtctaaaagaaaataaattcggtgtaagtgttgaacaggctcgagaagtttatcgccaagcaagtcaattggaaaatataaaaattgtaggaatagattgccatattggttcacaactgacagaacttcaaccttttttagatgctacagatcgtttaattgttcttatggagcaattaaaaaaagatggaataacattagaacacgtggatttaggcggtggtttaggggtaacttatagtgatgagaaagcaccacatccaagtgaatatgctacagctttgctggaaaaattaaaaaattatcaaaaattggaaattattttggagccaggtagggcaattaccgcaaatgcaggtattttactcactagagtggaatatataaagagtaatgaaagtcgtcattttgccatcgttgatacaggaatgaatgatatgatcagaccggctttatatcaggcttacatgaatatcattgaagttgaccgcactttgtcgagagaaactaaagtatatgatgtagtcggtccaatttgtgaaacatcggattttctaggaaaacaacgctctcttgcaattgcacaaggagattttatcgtacaacgatcagccggtgcttatggtgcaagtatggcatcaacttataattctcgtccacgagctattgaaataatggttgatggagagcaagttcatttaattaaacgtcgagaggagtttgctgaattgtggcatttagaaaaattactggaaatgtaaatttttctcgtaaatttcaactaactaaaattgagtttttattctgttgttacactgtgtttttggcaacaaaaattagaatataaaataaaacaatataaaaaactgaataattaaaaataaacaatatttaattccaattaaatataattaattaataaaaaaagatatttaatctaaatttttgttgttgactggataaaatattttgttatattgctaaaccttctgtaatgaaataaaaaatataaaaggtctataaaatgaaagatacaacacaaaagcgagaaacattttccggtcgtcgtgcatttatcttagcagcgattggatctgccgttggtttaggaaatatttggcgttttccttatactacttatgaaaatgggggtggtgcatttatcattccttatttaattgcgttattaaccgcaggtattccattacttttcttagattatgctattggacatcgtcatcgtggtggtgcacctttatcttaccgtcgttttaacccgcactttgaaacatttggttggtggcaagtattggttaattttattattggtatttattatgccgttattttgggttgggctgctagctatacctatttttcaataaataacttttggggagataagcctatagagtttttcctgaatgaattcttaaaaatgggtgatattactcaaggtgttagttttgaatttgtaggaatggtgacaggtccattaattgctgtctggttgattgctttaggaatattagcactaggtgtacaaaaaggaattgcaaaatcatcaagtattttaatgcctattcttgtcataatgtttgtaattctcgttgtttcatcattatttttgcccggtgcggaaaaaggattagatgcgttattttcaccagattggtctaaattatccgatcctagtgtatggattgcggcatacggacaaatatttttctcactctcgatttgtttcggtattatgattacctatgcttcttatctgaaaaaagactccgatttaacaggtagtggattagttgtaggttttgcaaatagtagctttgaattgttagcaggcataggcgtttttgctgcacttggttttatggcagcgacagcaggacaggaagttagtgatgtagcaaaaggaggaattggtctagcattttttgctttcccaacaattattaatcaatcaccttttggtgaatttattggtgtattattcttcggttctttaacttttgcagctttaacttcatttatttctgttattgaagtaattatttccgcagtacaagataaactaagaatacgtcgagtaaaagttacttttattgttggtttaccaatgatgttttgttcagtgattttgtttggtactactacaggtttaccaatgcttgatgtgttagataaatttgtaaactattttggtattgtggctgtagcatttgtttcattagttgctattgtttccaacgaaaaattaacttcattgggtaatcacttaaatgaaacatcttcttttaaagttggttttatctggcgtttatgtattgttttaacaacaggtattctagcatttatgttatttagcgaaggtgcaaaagtattctctgaaggttatgaaggttatcctgcttggtttgtaaatatttttggatggggtatgtcgttaagtttattagttgcagcattcttactttcccgtttgaaatggaaagatgaagcattaacacacaaaaaaggagaataaaaatgagtaacagtgctattatgatgatgatcatctctttggtaattatttggggtggtttagttgtatcaatattaagattacctaaagaatgataaatttcaaataaaaataccgcactttgatctgcactctaaaagatagggttaatttcccatctgattaaagtgcagattttttatgatttcatattaatagtagtaggttataaattccttaaccgtcatctattctcgcatgagtgatgacagtaaaattatgctgaaatagcaattttcaaggtgagttcatgggatgggtatcgatccatcattgatcatcatcaaccaagttaaacgaaaacagtatcgcaagtgcagtggagttttttgataacatactctttggttaataactgatttaaccttaataattttttgagtctagttttagttttgtgacaatgaaaaaatcccaaaacttgaaataaaaaatgattttatattgatttagtgatgaatcccctgcttttaaacaggggagggtgattttattgtaaaagtataatctcaacaggttttaatcctgctctctctagacctttattaagtttctttaaagcctgttctttttctgttttagtcaatacattgacattcttgtataaaagtgcggcagtaagattccaaaataaaatgagatttacaggaatacctgagagttttaactctatgtagcaatttgctgctccttttaatttaaaggattttatatctttaatgtgtattttagaaagaagcctttcgtgttttatcgaaagatttgggagatcttttattctttttttccgagcaagttcttgtgcaattttctttgctctagtttgagcaatagatagatagagaatttgacgaaaatgttccttattctgtgtaatttcttttggcaatagataataatttcctatatttagttgagggtttggggttaaagctaaatatgataaagcacctaggctttctaggtatttagctaattccttctctgctcgaatataaaattttccttgctggtataaaccaaacataagacctttcttaaataaaccataaccagaaaaaagatttttcacagttatagttcctatcaattcggtaagttcacttctaatattttcagtgtcttttaatgatttggtcatatataattcaacctcatttattgtgacaaaataaataaaaaccttttgattagaaaaaatctccaatcaagataagttataacacagagagtggattttattttaaataactttctaattttgttaaagtttgtgatagagatcgagaatttataaaaaagtttgctattttctttagattttttagagaaatgataaaatgtgctaccgatggtttacattatcattataattgtttaaaaaccaaacaaaaagattaaaaaaagagaaaattaatcaaattttgataaaaaatataaaaaaagcttgcgttgaaatataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggatgaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatgaccctgggtggagacactcagggttttttgttatttgggataaggcggggaagagagaagagrgaagaggaaactgggagaaaaaaagtaataaggtgataacgaggtagtcataaaaagtagggtaatgaagcagagtgaagaggtgcggtaggaaaattgtttttttttctaccgctctttttttaggtgatttatttttagcgatttgcttgacgataaatgatgatcagctactgaacgagaagttacttctagcacaacatttcaaacagaattttctctatagatttctttaatttacaatgggttatcttcatttatagacagatatcattgctaatctacttcagaccattgtaaattttccttattgtcttattaccttgtaggtaaaagtgcgattaaaaaatcatatgtttctttagccaatgaattactgtatgaatgttttgattgtgtttgtaaggtgttacaatataataacgctgattacacggtttttctaagcctttgaaaggggttattaattggtcattaactaaataaggtgtgattaactgttttcgccccattgcgatgccaatatggttaattgcagctgttaatgctaaattcgaacagtcgaataccatagattgtacttggtttaaatcaagactgtaattgaaatatgttaaccaactctcccattcttcaaaatcggaattgtaatgccacgcttgtccgtcatgaagcaataaacagtgttctaaagatttcggattcccatgaagtttatgtttctcggcatattcagggctgcaaaccggaataacgctttctggcatgagttcatagtgatgtaaattttcactatataaatcatcataatagatagctaaatctactttatacctattaaaatcaataacttcattgccagtcaaaatattcagtgtaataaacggatatttttgattaaatcctgctatagcaggaataagccaactttgagctaaggaagggcgagcataaattgtcaatgtgccactgatttcttgattacgtatttcaaaaatttctttatttatgtgaggtactaactatttttacatagataaaaaacaaaaaatttggtcggaaaaattgcggtggggctttgtgtggcaaggctttgccgttttttgtttgggggagttatgcaaaaaataagaatggttaaaaatggtaaataatgggtggtttttgcattattttttgcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatacgcccttgtatcaatgcccgaagttatccaaaccgaaatccgtaagaaatttgcggtcgatgtagtgaaagctcaaccgaaacaactcccctcagtgcgtgcagaagtggatttggcgaacctaactacaaaacaacgcgagatagcagatgctcgaatggcgttagtgcagtatgtgctagagcttgaacagtcaatgagtcgaattaaagcggtgacttatttatgtgatcttgcaaaaaatggcaagttgcctgcacaccttgcagagctaattgaagtggcgaatgctaagaaatcagctaagcggacactaagtgtgcgtaccttaaatggttgggtggtggattactgcaaagccaagaatgtagagcaacgtttgaaattgcttgctccacaagtgaaacaggcggttaagcctgaagagatttggtggctaacctcttttttaggtgtttaccgtcagaaaaatgggatttgtttaacggaagcctatcgtcaatttaaagttgaatgggcaagtaattatcaagaaaacccgattttactcgcagaaatgccaagtttgagccaagtgcaacgagcgatggcaaagctaccgctctatgtaaaagagtatggcagacgaacaggctcacattacaaaacgttattaagttatgtgaaacgggattggtcagcattaagagcaaatgatgtgtggattggggacggtcacgccatgaaactgaaagtggctcacccaatacatggcaagccatttacccctgaattaaccatgattattgatggtgcaagtcgaaaaattgtggggtggtcgatggcattagcggaaaacgcttttgcagtagcagatgccctacgccatgccatatcaacccatggtgtcccagctatctactactcagataacggtggtggggaaaagaataaatttttagatgcggaagtaacggggatgttaccccgcttgggtatcaagcacgaaacagggattgcaggtaatccgcaagggcgtgggattatcgaaagattaaacaaaacagtggggttattgattgcacgccagtttgagacttactacggcacaggggcagaccctgaaaccactcgcaaggtgctttacggtgtgaactctttggctaatgcgaaaggcacagtgcttacgccagtgcaaaaaagagcgaaaggcaagctcccaagttggcaacagttactggatatggtgcaacaagtggtcgattggtacaaccaagagcatatccatagcgaaattagatgtataccagctaagaaatatcagcagatgttacacccagaagatgtggtcatgctgacggatattgaattgcgtgatatgagccgacctgagtttatccgcacgcctgagcgaggttggataagttggtgtaacaacaaatattttaataccaaattattagcgatagatgggcaagaagtagtgattggaattgatatccataacgccgaaagcatacaggtgcgaaccaaagacggcagatttgtgtgtgatgcgatttggaatggtaacacaagagaagcctttccagtggcgatgctggagcagcagcgtaaagaacgccatcaacgtcgcagtaagcttaaagagcgacaactggcagagattgatgtggagcttaatcctgttattacgattgagcataaacatgattttaacttgttggcaacagcaagtaagccgaaaaaagagcctgtgccgttattttttacacaggcagaacgagaagattacgaaaaaaagttagcgataggaggctaaaaaatgaaaaaccaacagcttaaagaatttatgcaagcccaagggttaggacaaaagcaagtagcgaatgcctttggtgtatctgtggcaacagtgagccaatacttgagcggtaaatatcaaggcaactgcgaagaattagatcgcaaagtagatgaaatgctcgaacgccagaaagctaaagtggttgaggctaaatataacgctgaatttgtaccaactttagcggcaaaacgtggaatggaagtgatgcagtttgcccacgttgaaggtgaaattaatgtgatttttggggcagcaggtttaggaaaaacgcaaatgttgaaagagtacgctcgaagaaatagctctgcggtgttaattgaggttgatccgagttgtacaccaaargtattgctacgaaaaatcgccgaagcagtaggagcaacagcacgaggaattaataatgagcttctcgacagtatcgtaaacaaactcaacggctcagaacgcttattaatggtagacgaagcagaattactctctacccgctcgctcgaatttatccgccgtatccacgacttgaccggtataggggggtgttagcaggcatgccgagattattagttaatcttaaaggcaaaaataacgaattagcccaattatatagccgaataggttttgcgtgcgatttgggtaatgccctacctgatgatgatttagcgttattggctgaatctgcattaggtacagatgagtttaacgcaccactgattaaagcgtgcaaaggtaatgcacgccgattaagcaaactgatgcgtggcgtggtgcggtcaagcgaaatcaacggcataccaattagtgccgagctggttgagcgttatgcaggtatgttgattagttaggtgacagatgacgtaccgtcaaatttatgcggcgtaccgtggagatgagaacgtggcagacggtacggcggaagaattcggtattatgtagcagttgcacaaaacctaaaatgcaatctcaaccgcagtaaaatttttgatgcccttaatcgttgagggcatttattttggtaaattttagctgattttctcacttgtttgccaatgttattggcttgcgatgtaaattttcccatcaatgggcgtagtcaatccgcttaaccttgtcaaaggtaagctgattcccctgttcattctaattagttttgtaattaagaaaattaggctgccaacaactcttgctcgtacttcattctttcattgagatttttgaagtaggactgggaaatttcttcagggctaaatgcggtcatactgataagctcttgcgtgcgatgattcccttgccagtaacccacccattcccttaatggtaatacccataagcaacgtttgagaatatcactaaataggtcgccattagacttttgacgattatctgacataaacgccacttggttggcataatgtagggcgtatttattatcacatttgtgatgtacaccacgatgtaaatcacggaaacgagcattaaaggattcggcgagattattactcacacctttggcactataacattctttatgattaacactccaacgagcgtagtgaaaatccaaacctttataggctagattttcatcacacataatatcattgccttgttttacgaattgatggtttaatgccaaaattgttttagcattttcagtatagtccattgtaacgatggtgcgatttgaaccccacaatgtttcatcattagaagcacgttgatttaggctgataatgaaacgtttagttggtctcaatttaggatagtttgtctttttatctcgttgtttatgttgattctttttaaaatttgctttgcgtagcttatagttaatcaacgtcccatcttcgtgaatttccccttgcaatggcgttaaatctcgagttttgaatagggcttcacgcagtttatggcaaaggacaaaagccgttttataactaatattaaggtgacggctcattgttattgctgaaatccctttgacttcattcgcaaagagaagaatggcagccaaaatatcaacaaacggtagtttatgaaaagcaaatgctgtattagttgtaatatagaagtggcgttggcaatgtttgcaacaccaacgtttgcgagattgaagaaagtaagcattgtggcgaataccgcaatgcggacaacaaacatcgtgaatattatcaggattaccccaacggtttgctttcaaaagttggaaggcttcatcttcacttaaacggaagatatgtttaagggataatgttttagatttgcttgaaagtaagtaatgagccataagtattccttgtgtgtacaaggcactcaaagctaaacgccagacataaaaaatcgcccacctgaattttcaggtcggctcaaagcgttttgccctgaataccgtactgtcacaagaaatacgtggactttaataaatgagttgcaaaccccaaatagtcccctaataaaagggttctacgcctatatggttcgctatgcttctttgaaagaaactaggctaaatataaataaatggttcattggcaaattgtcattgttcatcaacgatgaacggcattcaaaatagatctacgttgtttttctgtcaaataaaaaagcaacccattgctaggttgcttatgaactgtgattctaaaaaatggatatataacaagttaataaacactaacctgattacctttaatactcacaatatagttatgtgtaatatagtctgcactacctgataatctgttaccaatagaattagccataattctacacttcttcacaccgttgttatcagatatttctttagattcaaaagaagaaaatgcaatataattctgcattcttgttataccttcagcaatacttcctgcaccttccattgctcgaccaaacatatcccagagtggattagagcggtctaacccttgcgtagcgtgccctacaaaaaattgagcgagtttatttgcttgaacattttgagctcggattccttcgttaatgaatctgcggactgtttcttcaacaacataatcatcgcactcaatttccttttgaaaggtaggtactagttgtaaaggcgatatactaggcactaaaacatctatactaaatgcagtagcaatcactggaaaaatatattttccaaacttagaaaaagccattctattctccttgttgtttttcaggattttcagactcttttttctttaaactaggtattttgctaaataattctttaggatatgtgcatactattttcaggtatgtttttagaaattcggctgaattagcatcaagatgagatgttctacgatgtgcaatatagcaaccaacaataaggtagaagtaaatcagttctttcataatgtttccttataactaaaaatcaataccagggaaaaccttgtatagtatgtgtacagtctgatgtagtaactaacggtgtatatcaaccacactagttgtgggtacactcatcaattagtgggtaaaaaatgaatatcaacgagaaaatccgaagaatccgtgaatcaaaagaatggtcgcaagaacagatggctgaaaaactgaatatgtcattaaatggctatgccaagattgagcgtggtgaaacaaagttatacttagacaagttagagcaaattgctcaaatcttagatattgatgttgttgagttaatccaatcaggtgagaaaaatatctgctttcaaattgaatcgccgttaggttcggtgtatcaaggtgtgggggaatcatcgctgttgattgagattgagcgattgaagttgaatctttcgcatgctaacgagaaggaaaatttattgaataagttgcttgagcagaaagataatgagattaatgcattgaaagatttactaaaaatggctatgcccgaataaaacatataaaaacattgtgttctatcgtagagagataagataacagttgaattctattgggaaaaatatttaaggaataaatgtgagcaaacaaattaaacttagagcatttgaaattgtaaataatgatattagtaaaaatcttcaagtcgttaatttactcaaacaaaaattagatagttcaacttctagtaatgagcgtagaatgcttttaagtgaagatgatcctaagaaggaagaagatttaatttctcacttcaatactgatagaaacaacgttgtttttgcaacaatgttacgtattgcactcggtgataatgttcagcatatcgatgagactctttttcagaaagccaatttttcaattagtgacttactgaatgctaaacttaatacaagtgctatatataaagatcactactattttttgctatctgatcgttttgttgttacaaatctatctagcaggacgacaattactcgcttacaaacatatttaaactggtttctcggcgagttactagaactcaatccgataattgagcttaaagaagaatatgatttgagtaatgtaagatcactggttattcaagatcctgagaataagaatactacaaatattgacagtacggctaaagataacacgaactcaactgtggtatccaaattcaaagacattactcactttgcaatagaacatgtgaaagagctatttgctgatgcagaagatttagatgaaattgattttagtcagttagtttcagccaaactacttattcaaataaagaaaccaactaaaaattctccagaagatgttaaaaaagcattttcagcaatgttaaaacctgtatcagatctagataatatctcatttaaaactcgtaatggcacatcagttacaggaaaccaacttcagaagattaagcaagtagaggtagatactactgacacaggtaaattaaatgaacaaacacttttccaacaaatggagctttttataaaagaactcgaaaatgcaaacaaagattaaatggatagtaattagcttaatcacatttttattatcattcatcttatctccttttcttaatcaagaagataatatgaatcaagctattgtgcctaccatttacacattgtcaggtattatgttttctattggaatgggaatcgcttgtacatttaaccctagccaaattagaaatgaacaagtttttcaacgagtcaaaaaaaatataactaatgtaagaaatacatttttaatgtattttatgctatctacagttacgtttttaattagtcaaaatttagctagaaaccatatttccgtaatgaactttactttgatatttgatcctaaaatcttggctttattattttctatagtgagtcttatttattttattgttaatttccttactatccaaaagttgatttttgatatagccgaaagagctatgaatgaaagtaaataagtcaccttctcagcggcttatttatatttcatttttattacttcaatatttaagtaaatcatctaatttaagacgttcttaattgaatgagcgaaatttagttatgagaaaaatttggtaggaaatcaatagaaatatttcttgatatattcataactaaatacctgtgtctggtgtattatctcagaaacaggtatttacaaaaattgtgggagagttctcacactaacactatatgactaggtcgtttttctacattaaaagtattgtatgtttcaatatcatctttattagcctctaaaaaagctttgagagatactgttcccattttcaatctatctacaaaggattggattgctttcctttcctttctgattcagataataatggaacaactatatttttagcatcgctagagcttatttctgccaatccatctgagcctctagctaatgatctcatttgaatagcccatgcttctgtattcaaaaaagcgagaagatcagctaaaaatacttctttgcctttttgtatgcgacacctgtgacaaccattagtgactattatatcggtttgatattcgcctatataacaccattttgccgcacttccccaaattgaaccaaaatacaaatcatgaggctcggaaaaatgtttagccctactaggtaattcccaaccatacatttcttgacttgtaaactcaccataagaaatatcttctaatatgaacatatttataacgatttatcccaattaaactattcttctctccagatgaagaaactttttcaggaagaaaattaactatatctcccaaacgtaggtgtggtcttaattttatattatatataatatttttcactatttgatttaagtaaatctgaaacattatcagttctaagccaactaaaataatttaaagctgacatagaatatcttattctatctaaaactactggaaaatcagtgtttagtacaagctctccatttttatcagatataaaactaccatcaatgggatttcttttatatacaggtttggctattttatttcctgcttcccaacctaagttttcaatagattctataaagaaactataatcttcagaatttaacgatgattttagtggttcttttcgtttttcaagaaacaatatactggcactaacatctgcaccgctgcttttaaagctaaatctaggtaaagcacaaataccagctatcttaacatggcgtaaaagccattctctaaaaattaaaaatttttcggaatgattccctaaataaccattaggcagaattattgctattcgtccttctttttttgcttttctcacgcataattctacaaaaagaagccctgattcctgctgtgatagcaatgaatttttatctaaaataaatgtatttttttctaatatccattgaaaccctaagtcaaaatttttaagaacctcagttcttctttctaaaatcttactaccaaacggaggattgcataatattaaattatattgtttataatcatcatttattgtttctaatgaatcaattttctttatattggttttcccatctccatttaataccatatttaatatagctacttgaactgcattatctgagttatcattaccccaaatataatctgcatgcccatgattaaattttctagcagtttgaaatgctgcaaccaaaaaatctgcgctaccacaagcaggatcaaaaacatgctcgccaaattttaagttcatcacatctacaataaagtctgttatcggtgttggtgtaaaaaactgtgcgagatcccacttataaagtgattttgcaaatttcatataaaatgactgtattatatctcttttagaatatgtaattctgatgggagataatacttttaatatatctaataacgcatcattttttattttaaaatcaggagtcaacggttttggtaaatgagaaccgtaaaaatcaataactcgagctaaaagatttttaaatctagggatagaaatgttatcaggtattcctaaagatctaaaatcttgaatttccatagcttcatgaggttgtccttccttgctatgttcatcaaatatttttaccaataaaatctttaagattaattcatatcttgcagaaatatcaaaaccttgttgatgaagagtattttcaatataatcaaatatttcaattaagttattgtttggttttgtttcattaaatgaaataggttttatatttatggaagcaccaaattcaggtaatagatttattaaaccctctctaatttcttttttatcatttgaaaaatcttgccaaaatactcgttgttctaaattatcccagtataatcctaaacatttttggatgtttagcaaaatctaaaaatggtttaacttgagtttcttttacatagtctgattttgaattatctttttttacttcacatagtataatcgcatgttccaaaattgaatcgacatcatttgtaattgtaactttatcaacatctaatacagcgagatcacatctaaagttatttctaccattattaccaaatttcttaactatttgttcgataataatattttgttttggataaccttgcgataataaatagtgtattgcctgtattctataatattcttcagtatatgttagcttatttttagatttttgagatgtttttaatacccctcgtatagggcagatgagttgaacttgctctactgacattatgccaccgcctttttcacagttgcatttgacaaaaattgaatggagattaagctattgcgttgcgttgaacatttttgagatccttattttagtatatcaagtaataattactgtttctctgaaatttctttaaaagaaattgagaaagcatcttttaagttttcaggcatagcacggtaatctgaaattaatttcgtttcttgctctgacattacagttttttgttgttcagactgaaacatttcgccttcaccacttaccagccagttcaaattcactccagctttagcaatggcagtcattccttctgcattaggttcacgttcaccgccaacataaccttgtagtgtgcgataagcgaccccgtctgttctgcaaaatctttaattttccagttttttgcttcacaaacttgtcttagtctttctgatatgcacatttgagcgttccattttcaatactagattgaaaaataccgcaaacgagtgcatatttgacattgaatgaggaatattctatcacgtttgagcgtgtatgaaatactctgataacataatttttggggctgtattagattagtaagtatgctagtctataaaaatgaaaataactcattgtaaattaaagaaatctatacagaaaaagctccttgagttttttgtgttagaagtgacagctcgatcagcagctaatattttaggtatcaatccaaattcaagtgccttgttttatcgtaaaattcgtgaagtcatcagctatcatttagcccttgaagccgatgatgtttttgatggacagattgagcttgatgaaagctattttggtggtcatcgtaaaggaaaacgagggcgtggagcaaccggtaaagtggctgtttttggcttgttaaaacgacagggaaaggtatttacggtggtggtagaaaataccaaaaccgaaacgataatgcctgtaatcacaaggaaaatcaagcctgacagttgggtttataccgatacatatcgtagctatgatgctcttgatgtgagccaatttcaccacgaacgcatcaatcattcggagttgtttgcagtgaaagaaaatcacatcaacggtatagaaaacttttggagtcaagccaaacggatactccgaaaatataatggaattgaccgaaaaaactttcctttgttcttgaaggaatgtgaatttcggtttaactttggaacaccaaaagagcagttaaaaacattgcgaaaatggtgtggaatttagggctgatctaatacagcccctaattttttggcaattaaaagtttttacggcaatttaaatttgcaatctaaattattaaactaatcagacatatatcatcagaaataactacaatgacccagcactttcttttaaccagcaaagctcgcacgctttcatctattaagatagctcgcctatctgacgatgaagcatttagcttattatgcgagctacgctggggggagtaaagaagtggtggtttgccctaaatgcggtgtacaacataaagcctactttatctctactcgcaaacaatggcgttgcaaacattgcaggcacacgtttagcattacatcaggaacaatttttgcgaatcataaactgccgattcaaacctacttattcgctattgtattatttgtaaatgtggttaagggaatttcagcctgccaactctctcgtgatttgaatgtacagtacaaaaccgcttttaccttatcacataaaatccgtgaaagcctgattgtacaacgtgagctttttccactttcaggcgagattcatattgatggtacttacgtgcattccgctccacgtccaaagaataagaaagttgaacgtgtagatagacgtttaaaacaaatgctaatccaaacaaacgtgcggtattggttatgcgtgaacgttacgctaaacaggaaaccttatctaatccgcagttagttggagcaaaaaggaccatcacgtttcctattttgtcagaaaacactgaaaccgtgaagaaattagctcactcacatattgagccaaacagccgtattcataccgatgaaaacagtgcttatgatgaattaatcgtagattacaacttacaacgtgtgaaccatcaaaaagaatatcgcagtgatgaagggattaccaataaccttgcagaaagttactttagtcgctttaaacgtatgtactacggacaagttcataaaatgagtaatatttatctcgataattacgcaaacgaaatagcctatcgggaagatactcgcaaactggataatttaacgattttcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaacgagaaaaagagcaggtataggctcacctagctctagttgaacgccgtattactttacttcatcaagccttagacgtaatgaacatcggtgaagatgaagttcatcaacacaacaccgaacattttaaatatcgagtttaccataaacgctttaacggcaaattaagccaacttatccaacaggtgatgaaagctgaaccacatcgtttttggcgggcagaagaaataacagaagcggtactcgttgcagataaacaagcccatcgtcctattactaaagattatattgagtctgtccgctccgcttgtgaacgccttgcaagacgagagataatagagagagttgaagttgttcgatacaaagtgattcaatggaaatggaaacaaagatagcggtagaataccactatcagaccgctgacaaacctccagacattgctttggaagtttgatctaataggcacagaaaaaaaagaaatgcctatgcttaaaaatatcgcctctccctgatacgaactcgagatgataagtcttgaacagcgtattcccaaagactatctcgtccgcaaggttgctaaagcgattgattttgaatttatccgtgatgaagtcgctcctctttattgccaagacaactgccgcatggctcttgatactgttcatttgtttaaaatcatgttattgggttatctcttcggcattaaaagtgaacggcagttagtaaaagatattgaagtcagtgcagcttaccgttggttcttgggaatgtgattaacagaaaaagtcattgatgccggtcccctaagtcaaaattatcttcgctgttttaatggcacagattttatcaagatgaagtgatagtaagaaaagctagaaaactcaccgcttgagtggttatccggagtgaagcgcaaggaagatggataaaacgcaaaaaataaacccacttttatcaggttgctggtaaaggtgggtttatcagtggtctgggctgaatatcactattcagttttttatatcatttccgcttactgtgttggttgtaatgtgctattcagtatgcttctagatgtttcaggagcaatttaactgccctttttactagagctaccataatccccgcacaaaagaacactggctctaatttatctcaaaacagttaaatttaagctaaaaaaccataaaaatggctttaattttgttttttttaggctataatttcaaaaaattatgtttctttataaggatttttgtaaatttatggctaatgtgataaatgaaatgtttattgatgtagtaaatgacgctcttactgggaaaaaagatagtcttttgatgagattgaaagtaatagctaaaaagctaaagaaagaactacctgacttagcaaaagaattggaatctttaatttccacttcaagcactaatgctgtcgcaagagggcaatcattaacacctcaattttctcctgttgatgccgataccagacaaaaattactaattgacgtatatccggtaattatggatacagttcctatatggtcagaaaaagtaaatactcagttaaatcgctttatagctgagtgggaaatgaaagaatccttacataaaggcgggctacatccatctacatctctgctcataagtggtccgccaggagtaggtaagacattatctgccaaatggattgctcataaacttgacatacccctcctaactttagatctcgccagtgtaatgagtagttacctaggtaaaaccggcaataatattaaagccgtactcaattatgcttcatcttttccatgtgtattattacttgatgagtttgattcaatagctaaaaagagagacgatacaactgatgtcggtgaattaaaaagattagtaaccgttattctccaagctattgacgaatggcctaagcaatctgtcttgatagcagcaactaatcattcagagcttctagatcctgctgtttggcgacggtttgacagtattattgattttgagcttccaaatcaagagctaattaaaaagtatctgatatctaaagatattagtaataatctgtcaaattatatatcaactaaattacatgatgtttcttatgccataatagaaagagccatcaatcaagctaaaaaaaattctatcatagaaaaaagacctttcagtgcaacattaattaatgaattattaggtgataatgttttactggaaaatgttattgaaacgatgttatcaacaaatatttctcaacgaaaaattgcacaagacttaggaatttcaagatctcaaatacaaaaatttgtgaaagaacaaggattacaacaatgaataataaaaatatgcttcttggttatggagaaacgcttactagcccagtaaaattgaatacaggcggaggacctaaaaataagccgtatacatatgaagaaaacaaacctgttattgtagcgcagctaaataaagtcatttctgaaattaacgacacactaccgcttgcaatgccagagggaaaagcagtagtaaaattcgttcttcatccagcttttttagctaaaagttattttccagttaagctattaaataaattttctcttcaaagtataggcagtaaggctgttagtattaaacctagaaaagatatcaaaaagagagggaagagagaagaatatacaaccgcctgtatttatgtgtccggtaaaaaagaaaattttcaggactttcttgatacattaaatgaagacaacctaaatcaaagcttaaaagatgattttattacgttagaaaatatatctacattaactacctcagataaaataaaaagttttaataatgatgaggttgtagctgttgaaatagctttacatacacccaataccccttcagggattgttgatgcttttgaggtatttgcaaaacaaaatggtgttttcgtagataaaaaaagaagcataagcgtaaaaggattaacattcatacctgctaaagccagtaaaaatatggcattgaaactcgcagaattctcttttctccggaacttaagagaattgccccaattacgggttaatgatcctgtgatattacgttcatctaccaatgactccactcttagccttccttcagaaggagctataaatcctgatttaaaagtcgcaatattcgatggaggactaggaattaataattttgatccttgggttaaagaatatatatggagtaatggtaataccagtgcgcaattactttctcatgggcaagatgttacatccactgttctttttggtgttgtgaataatgatactaaaaagcttagcgtaccttattgtaatatagatcattatagagtgttagattcggatattaataatactgatatagatttatttgatgttcttatccgtataaaaacagtattagaacaaacaaaatatgattacataaacctaagtttaggtccaagactcccgattgatgacgatgatgttcatgtatggacttcgacccttgaagaaattcttgctaaaagcggagctctttgcaccgtcgctgttggcaatgacggacatttgccagaatcactgaaccgaattcaaccgccttcagatttagttaatggattatctgttggtgcggcaacttctctatcagatgattggaaaagatgtttatatagctgcattggccctggaagaagccccgggtatataaaaccagatggtgttgcttttggaggatacactgaagaaccatttcaaacatatagtccgatgactaacggaattgtaagcactgccggaactagttttgctgccccgttagtattacggcaggcaatagccttaagtacatccttacaatataacatcacgccgttaacagctaaagctcttctcgtacaccatgcagaacctaaagattttccgcgtcatgaaattggatggggacgttttcctaatgatattaatgacattatctattgtagtgatgatgaagtaaaagttatttatcaaggaatactcaaaccatcacaatatatgagggtcttaattccaattccaaacatacctatacgaggaagtgtaacattaagggcaacattctgtttctcaacgtcagtggatccagaacattcccttaattatacaagaagtggacttgaagttattatgcgaaaaagtactgacgatactccaggacttacatttccattttttaatcagaaacgtatttatatggatgaaagtgaacaacgcgatgcccataaatgggaaaatacaataagaagtgaacacaaattcaaggctaacgagctaacaaccccatgttttgacataatttattatggaagagattgtggtatgcctgttgttcatataaatgaactggaagacttaccttacgttttggttgtaacattatctgcagaggaaatgcctgagctatataacctgataagacagagataccaaacactccaaccaattcaggtacagcaacaaattgtattacaacacacttaatattttagtacaataaaatatacatgataaaaatctgaatatcattgttcagctcagaccgctggcaaatctttaaagcaatgtgagcaatctttaggggcagcggtctgatagcggagaataccgctattttcttatgttccaatctcttttaacttccatctgttcttcgggttttgactacgccctacaatagaatgcttttcgataatcccctgactatgtaatcgtcttaatgcatgagaaaatgcaataacaactgactggaaatccgatttatcaggcgtatagccttccaattcaaaagccttaatcacaatctcatttgttgataaccactgatttggaaaatgcttaaaaactttagcaataaattcattcgggcgataagtgtaagctctagatttctcaccacgttgttttgtcgctaatgaaaatggctcactgtttaacgctatcaaggcttgctgtaacgtagcaatatgctgtttagccacctcaatacatctttcgaaataggtaacgtcttgtgttaatttagcgattttctgctgaatagcactcatacttacttgcttttatcatacataaaaatccttgtggttagtaaaactcacaaggattgtagtaaaatttagttaagtagtctttgtgcaactgctacataataccgcatttgttgcgtattatttgcttggtataaaacatcaccaaagtatggaatccttattaaaaaatactgaaaatggatttatggctattggtaatattttactgattataggtgccggaggggcatttaacagtattttaaaggcgagcggattaagtgatggattggctgagattttagcaaattttaatacacatcctattctattggcatggcttgttgctattgttttacatgccgcagtgggttctgcaacggtagcaatgatgggagcaacggcaatcgtgtcgccattacttgttacttaccctgatattagccccgaaattattgtccttgctattggttctggtgcgataggatgcactattgtaacggattctctcttttggttggtcaagcaatattgcggtgcaaccttgaatgacatttttaaatattataccggtgcaactttcatcgcttccgtattagcactcgggtttacatttttattatcaacagtgatttagaggtatcattatgaaaattcaacatttaatgcaagatcctttcattcaaaaattaatgcgttttgaagaagtgatgtggtttaatcctaaaagtgcgggggtaaaaacaggattgtcttacgttgggttggatgtatccgatactcaacaggcggcggaacgtttgcagcgttttgctccttatttttgtcgtgcttttcctgaaactcaaaaaacgaaaggtattttggaatctgaactggtatctattgataagatgaaatcggccttaatcgatcattatcatatgccgatacaaggacgtttattgctcaaaaaagacagtcatttaccaatttcagggtcaattaaagcaagaggcggaatatacgaagtgttggcttacgcagaaaaattggcattagaacaccatttaattaccgaaaatgatgattatagtcaattgtgcgatgaaaagatcaaagattttttcagccgttatagtattgcagtaggatcaacagggaatttggggctttccatcggtattatgggggctgtactcggcttcaaagttagtgtgcatatgtcagccgatgcaagagaatggaaaaagcaaaagttgcgttcatacggtgtgaatgttgtggaatatacacaagattacggtgtagctgtcgctcaaggacggaaggcagctctttccgatcctaactgcttttttattgatgatgagaattcgacaacactttttttaggttattccgttgcaggtcaacgactaaaacaacaatttttggaacaaggtataaaagtagatgaaaatcatccgctctttgtttatcttccttgtggtgttggcggtggacctggcggtgttgcattcggattgaaattggcatttggcgattatgtacactgcatttttgctgaaccgactcattcaccttgtatgcttctcggtgtttatacagggttacatgataaaattgctgtacaagacttgggtattgataatatcacagctgctgatggtttagcagtagggcgtgcatcaggatttgttggtcgggcaatggaacatttgttagacggtttttatactattgaagatcaaaagttatatgatttactggggctattgcataagacagaaaatattcaacttgagccttctggtttggcaggaatgataggtccgttgcatatcaatcactccgattatttaagaagatatcacatcacacaagaacaattggcaaatgcaacacatatagtgtgggcgactggtggtggaatggtgcctgatgttgagatgcaaaaatatttgtcactcgggcgattttaaaatattctccccaagttggtttttggggagaagaaagagtgcaagtgcggtagatttttagagagtactggaaataaataataaatttgatgcgtcactattttgtttatttttaagtgcattctgatttatttgcaaacatattgcctgttaaacaagcaaacaattaagattttgtgattttttaaaaattattgttgacttaaataagaaaaaaacgtttaatacgcaccactgacttgttgcctcgatagctcagtcggtagagcaggggattgaaaatccccgtgtcggtggttcgattccgcctcgaggcaccattctactcctccttagttcagtcggtagaacggtggactgttaatccatatgtcgctggttcaagtccagcaggaggagccaactctatgttagttatgttatagaacgatgccttattgattattgttttgttaagagggtgtcaaatagaaagtcaagaatttatctcaaaaatagattttcccaatttaaatttaattcattttaatagtatcaatcattcatattaaacttaatgtcttcgggacatggtaattccgcctttcagtgttccctatgctagtatatgcatcaacaagcacaagttatattgcttataatatagaaatagtgcatttgcaatgcttgcagaatcaatgttggtgaggtgtgaaaaaatgggtaatgatgaaggtatatttttttcaaagaaaattaaaaaaattaaacgttaaataatgcttaataataaaacaaaagtgcttttcttttgttaatttggtaaagtatatacatcaaaattcaaattaattagttaaaaattaagaaaaatgatatgtatacatcaaatttcactaatttaatcttaaatgtagacagctataaagcctcgcattggttgcaatatcccaaaggaacagaatatatttcctattatattgaagctcgtcgagaaagttttgatgtagtgatgttcggtttacaggcctttatcaaagaatatttgcttaaacctatttgccaacaagatgttgatgaagcagaaattgtattaaaagcacacggattgcctttttatagagatggttggcaacatctaatacataaacatcaaggttatttacccttaaaaattgaagctgtatcagaaggaacggtcttacctgttggtaacgtggtttgtcaaataaccaatacagatcctgattttttttggttagtcggctatttagaaaccgcacttttaagggcaatctggtatccttccactgttgcaagtctttcctatttttgtaaaaagcaaattagacaagctttaataaagtctgcagatgatctgtccggtttagactttcaattacatgattttggtgcacgaggtgcatcaagccttgaaactgttgcgttggggggattagctcatttagttaatttcaaaggaacagacagtgtttctgccttaattgctgcaaaacgctggtataacattaatgaaatgcctgcattttctattcctgctgccgaacatagcacgatcacttcttggggtaaagatcgggaaataaatgcttaccaaaatatgattgaatgctttggtggagagggaaaactttattccgtagtatcggatagttatgatctttggcatgccctggaacatatttggggcgagaaattaaaagatttggtgatcgaaaaaggcggaagattgattattcgacctgacagtggcaatcctatagagattatttgcaaaaccctagaaattttagcaaataaatttggttatattcttaatcaaaaaggctacaaagttttacctgattgtcttcgcattatccaaggagacggcatcaatgctcaaagtctaccaaaaattcttgatgctgttatgcaaaaaggatttagtgccgagaatgttaatttcggcatggggggaggactgctgcaacaagtcaatcgtgataccatgagttgggcaatgaaagctagtgccatttgtattaatggacagtggcaagagatttataaggatcccattaccagtcaaagtaagcgttctaaaaaaggtgttttggctttagtcaaacagggaagtgattggttaacaattaaacaatctgagttaaatggacaaactaatcagttacaaaccgtttttttcaatggaaaactttttatcgaagaaaacttaacggaaatccgcttgcggaccacgtcctttttagtatgaccatattttatacagtgagaaaaagatgatatttgaaaaagtatcatcttttatttttcgcttaacaatgtacttactattttctagctagtggcggtacaaatgtaattcccatatcccaaggctgttcaatccacgtattttgtggaatgtcaataacataatcatcaactaaattagcccccgctggtttggcaaaaacagtaacaaaacgcgcatttgggtagagttcacgaattgctcgagcagtatttcccgtatcaactaaatcatcaactacaataaaaccttcgccaccattttttacctgtgctgcatgcaaaacatttaaattgccttgctgattatggtcataacttgaaatacaaacagtttcaatatgacgaataccaagttcacgagcaataactgcagctggaaataatccaccacgactaacggcaataatacctttccattgtgttgccggaagcaaacgttctgataatttacgtgtatgcatttggaacatgtcccaagttacaacatatttttcgctcataattcaccctaaagtcagttgatagcggagttccgcctgagaaataaaatggcgttagaataacctgaaatctatttttatgctattattttccttatttttcgctaataaaggataaaaaaatatgtcagatcttcaatctctgcaacctaaactactttggcaatggtttgatcaaatttgtgctattccacatccttcttacaaagaagagcagttagcacaattcattattaattgggcaaaaacaaaaggtttttttgcggaacgtgatgaagtcggtaatgtattaattcgtaaaccggcaacagtaggaatggaaaatcgtaaacctgtagtactacaagcacacttagatatggttccacaagctaatgaagggacaaatcataattttgatcaggatcctattttgccatatatcgatggtgattgggttaaggctaaaggtacaacgttaggtgctgataacggtatcggtatggcatctgcacttgctgttttagaaagtaatgatattgcacatccggagttggaagtattgttaaccatgactgaagaaagggggatggagggggcgattgggctacgtccaaattggcttcgttctgagatcttaattaataccgatactgaagaaaatggagaaatttatataggttgtgccggcggtgaaaatgcagatcttgaattacctattgagtatcaagtcaataatttcgaacattgctatcaagttgtgttaaaagggttacgaggtgggcattctggtgtggatattcataccggacgagctaatgcaatcaaagtgttgcttcgttttttagcagaacttcaacaaaaccaaccgcactttgacttcactttagcaaatatccgtggcggttctattcgcaatgctattccaagagaaagtgttgccactttggtctttaatggtgatattaccgtattacaaagtgcggtacaaaaatttgcagatgtaatcaaagccgaattggcactaactgagccaaacttgatatttacacttgaaaaagttgaaaaacctcaacaagtattttccagtcaatgcacgaaaaatattatccattgtttgaatgttttgccaaatggcgtagtacgtaacagtgatgtcattgaaaatgtggtagaaacatcattaagcattggcgtgttaaaaactgaagataattttgttagaagtaccatgttagtgcggtcattaattgaaagtggcaaatcctatgttgcttctttattaaaatctttagcctcattagcacaaggtaatatcaatttatcaggcgattatccgggttgggaaccacaaagtcatagtgatattttggacttaactaagacaatttatgcacaagttttaggtacagatcctgaaatcaaggtaattcatgcgggacttgagtgtgggttattgaaaaaaatctatccaacgatcgatatggtatctatcggaccaacaattagaaatgcacattctccggatgaaaaagtacatattccggctgtggaaacttattggaaagtattaaccggtatacttgctcatattccatcacgttaaaaattgatatacaagacaagtataaagagcggtgtaaatttgcaaagaattgagcaagcccattagataactttctcattcttaaaactaaaaatccttgtagaaaattgttttttacaaggatttttgtatcgaacaacaatctgtttaattcaacattttctttaactgatataaacactcaagtgcttgcttcggacttaactcattaggatcaagcgtttttagcgtttcaatcaccgcacttgtattctcctcctcttccattaaagttaattccccttgaacttgtgtcaaaacggactgtgattggtaactgttttgctgagaaagtgtttcaagctgttttaatttctgttttgccgatttaattacattttgtgggacaccggctaaagcagcaacagccaaaccataacttttacttgccgcaccttcctgtaccgaatgcataaaggcaatactgtcgttatgctcaaaagcatcaagatgaacattatggataccgtcgattttttctggtaaaaccgtcagttcaaagtaatgagtagcaaataaagttaaactacgaattttttgagccaattgttcagcacaagcccaagcaagagaaagtccatcataggttgacgttcctcgcccaatttcatcaataagcaccaaactttgctccgtcgcttgatgcaaaatatttgccatttcagtcatttcaaccataaaagttgaacgtccggaagcaagatcgtcagaagcaccaatacgtgtaaaaattcgatcaataggtccgattaccgcactttctgcaggtacaaaactaccaatatatgccattaaagtaatcaatgctgtttgtcgcatataagtacttttaccccccatattcggtcccgtaataatcaacaaatgacgcttttgattaagttctacgggattagcaataaagggatcttttaatacttgctctacaaccggatgacgcccctgcattatttgcaaaccgatttgcgtactaaattgtggttgaacataatttaaggtttccgcccgttccgccaaattggttaaaacatcaagctctgccaaagttaaactggctagttgtaaatcacctaagtgcggtaataattgatcgaaaatttcatcataaagttgtttttctaacgcaagtgacgctccttttgcttttagaactttttcttcataagtttttagctcaggaataatataacgttctacatttttcaatgtttggcgacgtacataatgaagcggtgctttatgtgcttgcccttgactgatttgaatataataaccatgcactgcattaaaaccgatttttaatgtatcaataccagtatttgcacgctcacgttgctccaaatcctttaagtagcgtgttgctccttcagacaaactccgccattcatcaagctcctcgttgtaaccttcagcaatgacaccgccatcacgaataagtaaggggggattatcaataatcgctcgctgcaaaagtgctaattgcacagaaaaatcagcaatttgttgtgaaaatgcaacaaagtgcggtatttttgttaattggtgttgaataaaaggtatttgttccaacgctgttcgtagccgagttaaatctcgaggtcgagcggaacgcagggcaacccgagcaagaatacgctccatatcgccaacttgacgtaaaagaggttgtaattcttcaactaaattttgctgcaacagcatttgaatatgttgttgacgatactgcaatttttcaatattgcgaataggctggtgaatccaacgtttaagtaagcgacttcccatcggggtaacacatttatctaaaattgcagcaagtgtattttcagttccgccagcaagattttgggttagttctaaatttctacgtgttgacgcatcaatttgtacagtatcgctattttgtaacaagctaatactttgaatatgaggaagtgcggtacgttgcgtttcttttgcatattgcaacaaacaacccgcagcacataatcctaaaaccgctttttctacaccaaaaccacgcaaatcttttgtaccgaattggcgattaagtaattgaattgccgtacttaattcaaactcccaaagaggacgacgacgtaatcctttgaattgttcaattaaatgtttatcctctaacgcttccgaatatagtaattcaaccggttgaatacgttgtaactccgcttgtaaactggcggcatcttgtagttcgctaatttgaaaacaccctgaagtcatatctaaaacagctaagccaaattgtgttttttcttgataaatcgtagcgataagattgtcttgtttttccggtaacaatgcttcatcactcactgttcccggtgtaacaatacgtacgacttggcgttcaaccggacctttagctataacaggctcaccaacttgctcacaaattgctacactttccccaagttgtaccaattttgctaaatatccttctattgcatgataaggtacgccagccattggaaccggttgtccagctgattgccctcttttagttagggaaatatctaataattcagcagctttttttgcatcatcataaaaaagctcataaaaatcacccatgcgataaaacaacaaaacatccggattttccgcttttatttttaaatattgtttcatcattggcgtgtgattttcgaatgtgtgcatggctttcattgtgttaataagtaaaaagaatgagtggaattataacaaaagtgcggtctgttttgctggtgttttttgtatctgctttcaagtcaaaagaataaaaatatgtctaaatgatcaagcggttgctcctgccttttatatttttatctcgtttccactaaataaagggtcaatttccggcattacgccacgccataaataaaatgcgtgagcagcttgcccaaccagcataccgaagccatcgctaattttggttaccccttgttttttacacaatgcaataaaaggcgtgtcgctttctttgctgtattgcatatcataaacggcagaggcaagttgtaaaatctgaggatcaatatcaatagttttaccttgtaatcctgttgatgtagcattgatgattaaatcaaatgtttgtatcggaatatgttccagatccaacgcttcaatggtgccaaaatgattgaatttatgtgctaagtcttcagctctactaaaagtgcggttggtaattaagatattttgttgagcttgtaataaaggcaataaaactccttttgtggcaccgcctgcgcctaaaatcagtattctttggtttggtttgagccaatttaaacgttgtaaatcgctcactaaaccggcaccatccgtattatcagcaaataatgttccatcagctaatttttttaaggtgttacaagactccgcacttaaacaacgcttgctatgttgttgtgccaatttaaatgctcgctctttgaaaggagcggtaatattgcagcctttagcaccttgtgcaaaaaaatcgctcaactgttgttcaaatttttcttcatcacccaatatcgctacataatctaagttttgtcgagtctgcttcgcaaaatatcgatgaagttgaggagatctactttgagcaatgggatttccccaaactgcgtatttatccattttttatccttgtctaactaattgattagtaaataaatcacgaatttcagatggttttgtggctgagccaactgacatatccaatacaggaaaatccgccccgaattgtaacctgacttcatcgctggttttgcaaggtgcaatcccacttaaattggcactggtagaagttaaagcaaaacctgtttgttcgcaaagtattttgatggcgggatgttggcttactcgaatagctatactattaaaattgccacataagaatttagcaatatctttttttgccggcacaatccatgtaatggggcgaggataagtttgttgtagtttttgccaatgttgagaattgatctgttccttatcaataaaagaaaaaaaataatctaatttgggtgcaactaaaattaaacctttttctcttgggcgttgctttaaaattaataatttttctaccgcactttgactaaaagggttgcaacctaaaccgaaaacagcctctgtcggataggcgacgacttcattttgtttcaatttttcaataatttgtgtgatattcatattgttgttttgaaaatatgttgacaatttttattgatacacaaccaagtgcggtgattttcgtctttttttttcaagattgcaccttgcatttggcaatgggggcaagggattaaatgaggtttttgtgctaaggtaaatttgcatttcgggtactgattacaagcataaaaattttttccttgccgtccatgtcgagcaacaatttcaccatgttgacattccggacaaacaatctgttgttctgtcgtttcttgttcttcatgcacgacaaaacgacattccggataaccgctacaaccgataaacatgccgtaactaccctgttttagttgtaaaaaacgaccgcacttcggacaattttgagcaagatttttaagtattttactttcattattagggtgtaaaggcttgatataatcgcaagatggatagttagaacaacccaaaaacaaccctttttttccttgtttcatctgcaaaacagcttcacattgaggacaatgttcttgatgtttggtatgttggaaaaggctttttgacatattcttttttcaatccttgtgagaaaaaacaacaataaacgatcctatcaataatatcaacttacaatcctaatttgaaagccattctagcacagtgtagaatgtgcaacattgtatttaggataagagttttatgaatttacaagatcattttttgattgccatgcctcatttagaggacgagaattttcagcgttccgttgtgtatatttgtgaaaataatgaacaaggctcaatgggattagtgctaactcaagcaacagatttaagcattgctgaattatgtgcaaaaatgaattttatgatggcggatgagcgtgaatattccgataaattagttttattaggtgggcctgtaaatttagagcatggttttattttacataagaaaacagcccaagaatttcagcatagctataaagttacagatcaaatttatcttacaacttcggcggatataattaatacttttggtaccgcacaatcaccggaaaaatatttggttactctggggtgtgcaagatgggagccgaatcaactggaaaatgaaatagccaataatgattggttggttgtgcctgccaatgaaaatattttatttgatgtgaacagttcggaacgttggtttgccgctaatcaattattaggtattgagcatgtaaatttttcgtatcaacaacaaatggaacatagttaatgtcaattacagttttagcctttgattttggcacaaaaagtatcggttgtgctgtagggcaaagtataacaggtacggcacaagcactcccagcatttaaagcacaagacggtatacctgactggttaaaaattgaaaaatgtttgaaagactggcaacctaatattgttgttgtcgggttacctttaaatatggatggtagcgagcaagatctcactcatctagcgagaaaatttgctaatcgtttgaacggtcgatttggtgtgaaagttgaattacaagatgaacgcctaaccaccaaacaagcccgtgatgaaatattccaacgaggcggttaccgagccttaaagaaagaaaaagtagatagtatttctgcctgtttgattttagaaagttggtttgaaaatggtgcttgtggggaataattacactaaaattaactcaatttccatttcttttatcgattcttgggcatttagtaacagcttgtcatcgcaaataatgctattgaatacatttaattcacaaatagaaaatgtagctgtttttccatatttagaagaatcagataccaaaattttgttgtaactggattgcaatattgcttttttaacaggcagttttttctcatccggtgtagttaagcctcttaaattccaagatgatgtggaaataaatgccagatcaattgaaagctgtttcaataactgtgtagccaattcaccaacagaggagaaattagatttattaattgatcctcctgtatgaattaattcacattgtccatgtttcatcaagaaattagctatcacaaaatcatttgtaatcaccaacagatcttctcgttgagcaatattatgtgcgatttctaatgttgttgttccggcatctaagtagatagttgtatttaccggtattagctcagccgctcgactaccaattttttctttttgtagcgtggaaagcaaagatttgtcattgtgtgtcggttcaataaataaatgttctaataatttcacaccgccggaaactgaaacaacaataccttcttgctctaatttttgaatatctcgacgaacagtcatgtgagatacacctaataattttactaattcattgatactaataatctcttgcttactaatcagcttaagaagttttttttgtctttctgccggtatcattttttactcctgattttttacataattatatcactttttccatttaggctaatatctataaaattaacattatttaacaaataatgttaaatagtgtgatcatgatctcattttttttgtaaaaaaaagtgcaaaatacaccatcaaataactttaaaggagtgatcagtatgaaccaaaaactattttctgtcgctgttattggtttaggtgcaatggggatgggagctgcaaaatcatgcattcaagcaggattagatacctatggcgttgatttaaatttacaagccttagagattttaaaaacagctggagcaaaacaagtgagtacaagtgcgataggttttgcaaaagatttagatgctgttttgctattagtcgtcaatgcaaatcaagtaaataatattttatttggggaacaaggattggcacagcatttaaaacctaaaactgcggtaatgatttcatccactatttctgcacaagatgccaaagaaatttcacaaaaattaacaaaacttgatttgataatgttagatgcacctgtatcaggtggagctgcaaaagccgctcaaggtgaaatgacggtaatggcatccggatctacagaagcttttgagaaattaaaaccggttttagacgcagtttcaggcaaagtgtataacatcggagaagagattggtttgggtgcaaccgtaaaaattattcatcaattactggcgggagtgcatattgctgcaggggcggaagcgatggcattagccgcaaaagcaggtattccacttgatttgatgtacgatgtagtaactaatgcagcgggcaattcatggatgtttgaaaaccgaatgaaacatgtggtagatggcgactatacgcctctctccatggtcgatatttttgtaaaagatctcggtttagtgaatgacacggcaaaatctttacattttccacttcatttagctagcacggcttattcaatgtttactgaggctagtaatgcaggctacggtaaagaagacgatagtgcggtaatcaaaattttcagtggtcttgatctaccgaaaaaaggaggacactaatatgttaggtgtcatagcagatgattttaccggtgcaagcgatattgcgagttttttagtcgaaaatggcttaaaaacagtgcagatgaacggtataccaaaaatcgcacttaacagcaaagttgatgcaattgtaattagcttgaaatcacgttccaatcctgttgaggaagctatccaacaatcgttacaagccttagattggctaaaacaaaatggctgtacccaattctatttcaaatattgctcaactttcgatagtactgaaaaaggcaatatcggaccggtaacggatgcgttaatggctgcattagaaactgattttactgtcattacccccgcacttcctgttaatgggagaactatctttaatggttatttgtttgtaggtgatgtattgctgaatgaatccggtatgcgtaatcatccgattacaccgatgaaagaggctaatttagttcgcttaatggacgcacagtctcaaggtaaaactgggttattgacttatgcagatgttattcaaggtgcagagcgtgtgaaagcacgttttacagaattaaaacaacagggctataaatatgcagtagtggatgcggtagataattcacagcttgcggtacttgctgaagccgtggcggattttaaattggttaccggcggctcaggtttgggggcttacatagcagcgtatcgctcaggcggtcagaaaggaacgaatgcttttgtaccgaataaaggcaaaacggttgtactttcaggatcttgttctgtgatgacaaacagccaagtcaatgcgtataaagcccaagcaccaagttatttcttgcaagccgagcaagccattaacaatccaaattatgtggaagaactttatgcgtgggttgttgaaaatctaaatggcaactttgcaccgatggtttatgccactgtaccgcctgaaaaattgaaagaaatccaacaccagtttggtggggataaagcaagccatgcgattgaaactacatttgcaaaacttgcaaaaaaattgaaagttgcaggggtaactaacttcatcactgcaggcggtgaaacatcgagcattgtagtccagcagcttgctttctctgggtttcacatcggcaagcaaattgcacccggtgtgccatggctacaagcagtcgaagagccgatttttcttgccttaaaatctggtaacttcggtaaagagaatttctttagttttgcacaaggaatgtgtgtatgacagaacttgaacaaaaacaacaaatggttgctttagctcgttcattatttgagcggggatatacagtaggtggtgcaggcaatctatccgtgcgtttagataaaaaccgtattttagttacgccaacaggttcttcactcggacgtttagaagcagatcgactttctgtgttagatatgcaaggaaatgtgctttctggtgataaaccgtccaaagaatctgttttccacttagcgatgtatcagaaaaatccgagttgccaagcgattgtacatctacattctacttatttaaccgcactttcttgtttggaagatttagatacagaaaatgcaatacgagccttcaccccttactacgtgatgcgtatcggcaaattacctgtaattccttactatcgcccgggcaacttcaatattgccaaagaattaggcgagagagctttagatggcaaggcttttctgcttgcgaatcacggagtggtagttacaggagaaagcctaatagatgctgtagataatactgaagaattggaagaaaccgccaaactctattttattttacaaggtcaaaaagtgcggtatttaaccgatgatgaagtcaatgacctgaaacacagaggaaaataaatatgcccaaatttgctgcaaatttaaccatgatgtttaacgaagtcccttttttagaccgatttgaagcagctgctactgccggttttaaatatgtggaatacctttggccctatgattatccagcagatatgctaaaggaaaaattagataagtatggtttacaacaagttctatttaatacttcagcaggcaatgtagacgccggcgaatggggtgtctctgcgattccggggcgtgaagcggatagtcaccgtgacatcgatcttgctcttgaatatgctcttgccttaggttgttcacacgttcatgtgatggcggcagttgtaccgcaaggcgaagatcgagaagcctataaacagactttcatcaaaaatgtgcaatatgcggcagataaatttaaaccgcacggtattaaagtcttgttagaagcactcagcccggaagtcaaacctaactacctgctgaaaagtcaattcgacacgctagaaattgttgaatccgtcaaccgagataacgtctttgtacagttggattatttccacgcacaaaatgtagatggcaacttgtctcgcttaaccgacaaactcaacggcaaatttgcccatatccaaattgcctccgtgccgaatcgccatgagcctgatgaaggtgaaataaattaccaatatctctttgataaattggatcaaattggctatcaaggttttattggctgtgaatataaaccacgctctgacaccttagcaggtttagattggtttaaaccttatcaacaaaaataaaataggtgctctttatgaattatcagttactttcttatcctctagatgtaaaagatcctggttttccaaatgaacccactctaacttatgatatttgtacaagtactgcacagggagatgtgtataacagtgctatgattcacttgtttaatcatttcgggacacattttgatgcacctaagcattttaatccacatggtttatctattactgaattacctttaatgtatttcatttatgaaaaacccctgttaattgatttgcctaaacctgtcggttcgctaatcgaacctgaggatttatccccttttttaactcatataaaacaggctgattgtttattaattcgtactggcttagaacacttaagatctgaaaatccacaacaatatgctgaaaatggtgttgccgtaagcattcaggctgcaaaatttttgattgattatgccagtaatttaaaagctattggatttgattttatttctcttgcttcaccagcgaatcctgatcatggcatcgaagctcatcaagtaatgttaggaatgtataaagaaaaatttatttgcattattgaagatatgaaattatcgaagcttaataaaaaaacattaaaacgtgttttagctatgcctttacttgttaaaggaattgatagtgcacaagttactgtgttagcagaaggattttagtatgaactcaatgaaaaattatttttggggatgtgtatttttattatttactttcctaagtgcttatcttgcttctttatatgatcgtgattttggacgaattgaagtcagttcagtaagttttatgacagaagaaatgcaacctatggtagctaaactttatcgtcctgtttccgcaaccgcagaaacaccaaaacctggattacttgcattacatggttatcaaagcgataaagaagcaacaagtacttttggtgctttagaattagcaaagcgtggttttgtcgtattggctatagaccattttggacatggctattcaacaaaattacctgcatcaaataagaacatgagtggagcaaataatggttatcaatatttgaaaactttacctttcgttgataaatcacgtttaggtatttttggacattccactggtgcattaaatgcaattcgtgttgcaaaactcaatcctgatcataaggctgtcaatggattaagtagtaatggcggtgacatggaactgaataactacttattaactcaaggcttatatgaagagataggcggatatcgtgaaaaaacattccctgttaaaaatttagttattcaccccaaccgcttaattgcttttggtttacctgaaaacgaatctttagaatgggatcatacctatggtagttttaaggatggttctgcacgccgtgctgctatagttgatggtacacaccttggtgtaatgattgcttctaatagtaataaagaagctatcctttggtttaatcaagcactacaagatggagaaaaaggggttgattggatagaagcagatcaacaaacatattggtataaggaattttcaggcttgtttgctttgggttcagctttaattgctacattattttttgcaaacggtttgttaaatagtgcttatttttctgttgtatgtaaaccggtaagcgagaaaactgcagttactgataaacaatggtggaagtttacaacagtcaatattgtattaactatgttactttatccattatttactcaatggggtggtgctaatgaacctattgcatctaaactgagttttatgccattagaaatgggtaatggcattattctttggttagtggtaagtagtatcattggaatcattttatttagtttatggaaaagaaaagttgctgtttcgctggcagaatttggtgtgactagccattcttcagtattaacgacaagtcaaattattgtgcgttatttacttctaagtatcctattaattttaggattgtatctactcacaagtttaatttatcaagcttttagtgttgaattacgctttctatggcctctattaaaaccattaacagctgaacgttttagtttattttttgtttattggttaccaattttagtgtttttcttcatttttaatggattaattgtttccgtgcaaatgaaacaaaaattggctacatcttttagctcaactctcattatttggagcataaaaacaaccatttttaccacatttggattagttatattgtggttattccattttgtccctaattttatgcaaataggtccagggtttgatttacttgggttaccacaattcggtggacgttggatgatgatgttagctgtgattattcctcaatttattgtatttactgtgatcaatcactggtgctatttgaaaacgggatacatttatttaggagtatttttcacctctctattaatgacttggattttagtaggtggtcaagtaatcggtcggttcctcgcataaaaattaattacttagaaaatttttaacgaagtagtaaaaagccctatttttcaagggtagggctttttacaccctgcaaacccaaaattgcattaaaaacaagcagtttttgtttaaagtgcaatctattttaaggagaacacaatgaaaattgttattacaggaggacaaggttttttaggacagcgtcttgcaaagactttgttatccaattcaactttatcaatcaatgaattagtgttgattgatgtcattaaacccattgctccaaacaatgatccacgtgtgcgttgtttggaaatggatttgagaaatcctgaaggtttagatgaaattattaccgaaaaaacaaccgctctttttcacttggctgcaattgtgagtagtcatgcagagcaagatcctgacttaggctatgaaatcaatttcttagcaactcgcaatttattagaggtttgtcgaaaaaataatcctaaagtgcggtttattttttcaagttctttagcggtgtatggtggtaatttacctgaaattattcaagatcacaccgcagttacaccacaatctacttatggttctcaaaaagcaatgtgtgagttattgatcaatgattattcacgcaaaggctttgttgacggcattgtagttcgattaccaaccatttgtattcgtccaggaaaaccgaataaagcagcctcttcttttgtaagtagcattattcgtgagcctttacagggtgaagaagccatttgtccggtttcgtcagatttacgcctatggctttccagtccaaataccgtaattaataattttattcatgcgttaactttgccatcgctaccacagcgtagttggcacattattaacttaccgggctttacggttagcgtaaaacaaatgttatctgatttagcttcaataaaaggtgaaaacatcttagaaaaagtgcgatttgaatttgatgaaaatatcaacaatatcgtcgcaagttggccggcagagattgataataaaactgctcttaaacatggctttaatgtggatgctgatttcaaagaagttattcaacaatttattaaaaacgatatgtaacttaggagcaacagtatgtttgacttaccaattccaatcattggactattgattgcggtatttgtcttagtctatttagtgttaaaaacacgtgttcatgcatttattgctatgctgattgcttctgcgattgccggccttgttggcgggatgtccgtcaatgaaactctcggtgccattagtaaggggtttggtggaaccttaggcggtattggtattgttatcggtttaggggttatgatgggaagcgtgcttgaagtttcaggggcggcagaaaaaatggcttacagcttcatcaaactgctcggtaagaaaaaagaagagtgggctttggcaattactggttatattgtaagcattcccattttcgttgattcagctttcgttattctttatccagtggctaaagcattggcaaaaaacggaaaacgttctcttttaaccttaggcgttgcacttgctggtggcttagtggtaactcaccatactgttccaccaacacccggtcctttaggtgtggcaggattatttgctgttgatattggtgctatgttgttagtagggatggctctcgctatattgccggttattggtattgttctttacgcaaaatggctagataaaaaatatccggaatttaaccaacaagttttcactcaagaagaattgaaacaaaaatacgatgactatattgaaagtcgtgagaaaaagaatttaccaagcttagggttatccttactgccaattgttttgccaatcgttctgatctttatcaaagcaatgtttgatttaactgcaaaaggtcatgcggaactggctcaaatgggagtttatcaattctttgcttttgttggtcatccaatgattgcattagcaatcagcgtattagttgctgtttataccttattaccaaaagcagaccgtgattcgaccgcacttcatctcgaagaaggagtcaaaactgcgggaattattttattggtaaccggagccggtggtgcattaggtgctgtgctacgtgacagcggtgcaggtaaacaactagcggaacaaattgcttcattgccaatttcaccaattcttattccgtttattgtttcaacccttgttcgctttattcaaggttccggtacagttgcaatggtaacggcagcctcaatatccgcccctattttggctcaaattccaggtgtgaatatgttgttagcagcacaagcagccacaatgggttcattattcttcggttactttaacgatagcttattctgggttgtgaaccgtatgatgggcatcaatgatgtgaagaaacaaatgatagtttggtctgtgccaaccacgattgcgtgggggattgggggtatcagtgtgattctctgtaaccttgtctggggtaacgatggctcattatttgatcttttgttccctattgctgtaatggcaattattgcattctacatcaagttccaaaatagaactttgaataaataatcaacgcgcaaatagactatgaatgttattcgtagtctattttttaatctaaatgaggagtgaatatgaaaaaatattttattttggctagtggtttgctgttgtccactttggcctgtgcaatacctgatgaaattaaacctaattccaatgtgaatataactttgctcgcagaagtaaccgcacaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaccagtattgcattattacaacaataagtatattcaagtgaaagtgtgtcctatgaaatacagaacgcagttcttgaattaaattaggttaacttaaaaacggtataaacctatgtaatcagttatcatattaaagatattagctcgttgggtttattccaaaccaatgagctttttcacagtaaatttctttatgtagttttagattcctactataacggggtttacattgaatagatatccatcaaaattagtgtcctctacatcggataattcaagcaatttagttttaacattttctagatgttgccacattgctttacgtgccaaagcaggatttttgcgctgaatcgcatttaaaatcgtttcatgatctttaatccataagtgatggagatcattatgtatgatacgcgaatgaagctgtgtccacatagcattattaaaacgatatttccaaagttgctcttgagtttgaataaggacatcgtttccagtaatttcggcaagagcaagatggaattctttgtcagcactgcagtcatcaatattttgagcaaataattccttttctttatcaagaatttgcctaagtcgtaaaatatcttgtttggtaacctgttgtgcagcaaattcagcaatactgctttctaacaattgtcgtgcttgaagtagttcaaatgggcctacatctcttagcttattatctgcttcttcttgaagaagatctgggatttttatgacgtatattccggatccttttcttacttcaataatcttttccacttccaacattactatcgcttcccttacgatagttctacttacttcaaatctttcagaaatatttctctcggtaggtagcttatcgcctattttgtattttccttgagaaatttcctctttaagtatttttcctatttttgtgtaagttctagaattattttgcataaatcctcgcaatattggcacgccaaaataaatttatgtgatcagtatcacaattatagaaaattggaataccaaaaaatatactttgatgttactgtctgttcataaaatatcattgacgacattaaatgtcgattaactttgttaaagagggaaacattatgagcaaatacgtaagatcagtttgtctcgtggaacctaagaaggttgatataaagaccgtgttgtatcctaaaaaaggtgagtgtgatgttctgatcaaagtagagagtataggaatctgcggatctgatattggtgcatttagaggtacaaatccgctggtaacttaccctagaattttaggacatgaaattgttggtacagtcattgaatccggtgttggtatgccaaaaaatattaatataggtgatcgtgtaattctcgaaccttacatttattgtggacattgctatccttgttcaatcagtagaacaaattgctgtgaggcactaaaagttttgggggtacatattgatggagcaatgcaagaaattgttagacatccagctcatatgcttattaaagcacctgatataccgatacatgaactggctttagcagaacctttaactatttcattacatgcaattcgtagaaccaaagtaaaagccggagaacacgttgctatcatcggtgcaggtgcgattggactgatggctgcattagttgccaaagcttatggtgcgacaccaattttaattgacattttagacaagcgattagattacgcaaaatctattggcattccaaatataattaacccagcaaaagaaaatgatcttgaagctattaaatccattactaacggaagaatggctgaggttgttattgaagcgtcaggagcaaatattgctgtacaaaatacgcttaaatatacttcttttgcaggacgtattgctttaactggatggccgaaaaacgaaacgccactaccaactaatttaattaccttcaaagaacttaacatttatggagcaagaacaagcaagggggaatttgaagaagcattaaaacttttagaatccagaaagattgaaccgaagaatattattagtaaggtaattacatttgatgaaattcctcactacatcgaagagctttcagaaaatcctgatgattatttaaaaatcattgctgtattttaagtcttaactaacctatgaggtaataattatgaaactcaaaaaattaactaaagtattagttgttgcaggcttagtatttagtagttcggcatttgctaaaactgtaattaaaatcggacattttaattccgatatgcacccgtcaaatattgtattaaacgaagttttcaagaaaaccgttgaagaaaaaacgcaaggtcgctatgaaattcgtattttcccaaataatcaattgggcggcgaagatcaaatcgtaaatggcttacgcaatggtacgattgaaggtggaattaccggcttattgttacaaaatgtggatcctatttttggtgtgtgggaaatgccgtatttatttaaagacaatgttgaagcgaaaaaggtattggaatctccgattgcaaaagaaattggcgataaaatggaacaatacggtattaaattattggcttacggcatgaacggttttcgtgtgatttcgtccaataaaaaattggaaaaattcgatgatttcaaaggattacgtttaagagtgccattgaattccttgtttgtggattgggcaaaagcaatgaatattaacccgcaaagcatgccattaagtgaagtctttactgcattagagcaaaaagtgattgatggccaagaaaatccatatatgttgctcaaagattccggtttgtatgaagtacaaaaatacattatccaaactaaccatattttctcaccgggattattgcaattaagcttgaaaacttggaataaaatgtcaaaagaagatcaagaaattttcttagaagcggctaaattatatcaagagaaagaatgggaattagcgatgaagatggaacaagatgttaaagacttcttccataaaaacggtaaagaagtaattattccgtccgagcagtttaaagcagatatgttgaaagcctctgaaacactttatcaaaatttttatcaaaaatatgattgggcaaaaggcgtgattgaaaaaattcaagccgctaaataattgaaatcataggctgtttgttagcaaacagcctttttcctatcgctttttaggagataaaacaatgaaattttctaccacacttgaccgcactttaaagatgttggcagtgattgcattagtgacaatgattttattggtcttttttaatgccatgctacgttattttttcgattcaggtattgcttggtcggaagaatttgctcgaatttgtttcgtctatatgatttttttaggcattatcttagttgccaaagaaagagggcatttgactgttgatattgtgatttcttatttacctgcatacgtacagatgtatgccttattttttgctgatatattagtgttgcttgccttatcttttattacttatggtgcatatcaattaatgttgctgacttatacacaaaaaatgcccgcaacggaaatttctaccgcatttttatatttagcagctgtgatttcttccttatcttattttctcgtggtttttaccaatttatggaaacatttaaaactggcatttagaggagggaaagcatgatgttaggattatttttaggtagcttattcctatttttatttcttggtgtgccagtagcgttatcaatgttactgagtgccagttttatgttatggcatatggatatgtttgatactcaattaattgctgaaaactttgtaatgggtactaataactttcccttaatggcaattccattttttatgttgactggtgaaattatgaaatacggcggtatttctgagcggattatcaattttgctatgagtatggtaggacatattaaaggaggattaggttatgtagtgattatttcaggtttaatctttgctgggttatctggttctgctgtagcagacaccgcagcgttaggggcaattttaattccaatgatggtagctaaaaaatatgatgttgctcgttctacaggtttagtctgtgcggcaggaattatttcggtggtcattcctccaagtattccaatgattgtatatggaattaccgcaggtgcatccattaccaaattatttatgggtggcacggttcctggattattaatggttacaggattgtggttaatgtggaaatttttatatcgtaatcacgaagaaaatataaaaccgaaacaatctggtgcagaacgctggcaagcttttaaaaaagcttttttcccattattgttaccggtcattatcattgttgggttgcgtggcggtatttttactccaacagaagcaggtgtagttgcggcgatttatgcgggattggttagtcttggctatcgcagtttaaataaagaaaatttaatcgaagtctttttaaatacgattaaaactacttcaatggtgatgtttgttgcggctgcggcaatgatttctgcatttgcaatcactgttgctcaaattccaatggagttggtgcaatttatcaaaggattaactgacaattcaacggtattaatgttggttattatgattttcttattactcgttggttgtgtaatggatttaattcctgcagtattaatttttgtacccgtattattgccggtattgagagcttacaatatcgatattgcttattttggtattatgatggtgattaacttatcgattggcttaatcacacctccagtgggaacggtactttatgttggttcgggaattgctaaacttggcataagtaaaattagtaagggaatttcgccgtttttgttagtttatgttgctattttaatgttgatggtgttctttcctgatgttgtgattgtaccaatgaattggttatcttagtggtgcttattatatccattgttataaagacaaagttgtcgtaatgacagaagctggcaatatgaataaagcgatattttgtaataaaaataacgtataaatcgcaatttttacaaattgatttgacagaaaagatattcgggtgtaaaacattttttacatttcattaacattttggaacgttttatgctcaccattcatcatacgagtgaacaatcacttctctgtgaaattgctcctcctgctgaacttgccaagcaacagcgtatttggcaaattgcagagcaggctcggcaacttgccaatgtgcaagaagtagtggttggtatgaataattttactgtctattacgatttatttgcagatagtcaaccattaattgaaagcctgcaatcattgtgggaaaattatcaaccacaatcagttaaaacaccacgctgtattgagattccagtgcattatggtggcgagtttggtgaagatttatttgatgtagcacaatttcaccaaactacgccaaaagaaattattcgccgtcataccgaacctgtttacactgtgtttatgatcggttttcaagctggatttccttatctaaacgggttacctgaaagtcttcatacaccaagacgtgatatacctcgtactaaggtgcctgcaggctccgtcggcattggcggtagtcaaacaggaatttatccttttacctcaccgggtggctggcagttgctcgggcgtactgatttagcactatttgatattcaacaatctccaccaacactattaagtgcgggtgataatgtccgttttgttgcagagagtattcaactatgatctacattaaacaagtgcaaggttttgctcatattcaagatttaggtcgttatggctttcgttctctcggtattggacacagcggtgcaatggattctttggctttacaagcaggcaatttgttactaaaaaatgcaaataacgccccagcaatagaaattacgcttggtggaatgagtttgacatttgattgtgatactccattttgctttactggtgcattagtagaggctgaactggatggcatgcctgtattttcctactttcgttatactgccaaagtgcgtcaaactttaacgcttaaacgtattataaaaggtaattatacttatctttgcgttgccggcggttttcttgtaccacaggtgcaaggctcagccagtactgatctcagggctcaatttggtggttatcagggacgaatgttaaaagctggagactgtattcccaccgctttgcgtgatatacagttatcatttctcagtattgaaccaattgattttactcataagattgggacgacactttcgtctgaatatgaggcgtttactactgaaagtcgtgagcgtttcttccaacagagatgggttctgcaaaataacagcagtagaatgggctaccgttttgcagaaaattcgttaaaactgaccgcacctcttgaaatgctttcctatgcggcacctgctggcacagtgcaagtgccacctgatgggcaacctattgtactaatggcagatgcacaaactacaggaggttaccctaaaattgcttgcgtgattagtgctgatcttggaagacttgctcagacatcgattggcagtgcggtgcagtttgaattattaagccgaaaacaggcggtggcacgttttaaacaagatcagaactatttagaggatattcggagaaaggtaaatgaaacagattgatttaaatgtagatcttgctgagggctgtgccaacgaccagcaacttttacagcttgtcagttcagcaaatgtttgctgtggattacatgcgggtgattacaacgaaatacgcgaagcgattttgtgggcaaaagaaaacgatgtacgaattggagcacaccctagttttcctgatcgtgaaaattttggtagaaccaatatgcaattgccagatgatgagcttaaggtttgtttattttatcaacttggggcagtcaaagcattatgtgatgcgtctggtgtgacgatggaatatgtaaagcctcacggagcattatacaatatggcagcgaaagatcctcatttagccgcacttattgcagaaacagtgaaaagtgttgatccttcgcttaagttaatggggctttctggcagtatcatgctgactgttgctgaacagcacggtctagcgactatctctgaggtctttgctgatcgacattaccttgctgatggttcacttgtgcctcgtactcgtgatgatgcaatggttgagaacgatgaggaggctatttctcaagtgttacaaatggtgcttgaaggtactgttccaactgttgatggcggtaatgtggcaattaaagcagacagcatctgtttacatggtgatggtgaacatgcagtcgtatttgcaaagcgtattcgcagagagttaaaggagaaagggattttggttacaagttcaatttagtaagaattttactaaaaataggaatagatgttatttgttcgagtcgcctttcttttggttatttttcttttgtaaagcaaagaaaaatagcattgatttctaaaacaaaacataaggaaaacacaatgtcaaacaataaccgcagtgcccttattggagcggcatttttaatggcgacttcagccattggaccgggtttcttaacccaaacagcgacatttacccaaaacttatttgccagttttgggtttgtgattttgctctctattttgcttgatatcggggctcaattaaatatttggcgaattattgccgtttccgaaaagaaagcccaagatgttgctaatgcagtattgccgggtgcggggtattttctcgcattgcttattgtgatgggtggcttagcgtttaatattggtaatgtgggtggtgcaggcttaggtttgaatattcttactggagtatctcctgaaaagggagcaattatcagcggtattattgctgttggtgtattcctatttcgtgaagctggtaaagtaatggatagatttgctcaaattatggggtttgtgatgatcgccttgactgtctttgtggcagtaaaagccaacccacctatcgctgatgccgttgttcacactttcttacctgaaaaattagatgttattgcgattgtcacccttgtgggaggtacagttggtggctacattacttttgccggagctcaccgtttattagatgcgggcattaaaggaaaagaaaacttaaaagaagtgagcagaagttctgtttctgcaatcttaattgcttccattatgcgtgtggtgctgttccttgcggtattgggtgttgtttcaatgggggtccaactggatccaaaaaacccagcctcaacaccgtttgcttacgttgccggtaatgtcgggttaatgattttcggtatcgtaatttgggctgcatctattacctctgtgattggtgcggcgtatacctctgtatctttcattacatcattttcaccattcatcgaaaaacacaaaaattgctttatcgtggcatttatcgtgatttctaccgttgtgcttgctaccataggcagaccagcccaagtgctagtgttcgtaggaacattaaatggtttaatcttacccatctcactcggtttagtcttattagcagcttataaaacaaatattgttggtaactataaacaccctatttggatgacaattgcaggggctattgttgtcgtaagcatggcaattttaagtattataactctctcaaaatatgtttttgggctgtttacttaattgatttaaggcgatgatagcaattttcggtttctctttacttggaagagaaacctttttctattatgatcttgtctaaatttaacgttgctgtgtaaacatatattgcaaatgtataaaaatctatccttacttttacttgatgatttgttcgatttagaattagttgcgggtcttactcaatgtgagaaaggtaattaccttgattctatggtagatagacaacaaggaatgagtggctatatgttgcaattaactacttttggtacaggcattattttcgatggtaaacattctttttccactcatcgaggacaattgctactattcacaccaagtgcggttcaacattatcacagacatccagaaagtcagtattggcactataaatggatctattttttaccaaacccaaaatggaataaatggttaaattggtcaaatatagaggaaaaaatagggcgtattaccattggtgatgaccgctactttcaggaaatcagtcagcttttcagcaaaattgaagtcgaattgaaatcaagtaaattttttaaagaagatgtagccaccagtctattagaatacttacttatgaaaagtatttctgccgagaaaattgaagttattccagtaattgatcagcgtattttaaatgtttgtgatttaattttgaccaatttggctaaaaatgacagcttagaagcactagcaaaaaaagtatttttatcgccatcaagattatctcacctttttaaacaatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaaatggtattgttgttttgacgaatgaatctgtaggtcagccaagtgcagattgggatattgaaattattgataatgcccagtttgctgccgattatgttgaagaagtcgctaaagcaatgggcggtaaaggcggatatgttatttatgtcggtggtttaaccgtacctcaacataatttatgggcagatctatttgtaaannnnnnnnnnnnnnnnnnnnnnnnnnnnnnnnnnnnnnnnnnnnnnatgcctgttgcagaaaatatcaatgatgctcgccgtaccacaattgatttagtcaaagctcactctgacttaaaagcagtagtctctttcggttcacaaggtcctatcggtgccggtttagccgttaaagaaaaacgcttgaaaaataaattaaatgttttcgggatgatgattccttctcaagctgcaaatttaattaagagtggtgatattacgatgggtattacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgatttatgcaacgttataaacaaggtatttcaattgtggaaagtgcactttttttgaatcagtaaagttacaagcacatagaaaaagcttatgttgtgacgggctgaatcggttgtagaacatctgcccataattggttaataatgttacttaactgttagggcagattgatttttacgtgtatgattatgcaaaatattgtgctagatcgtcacttccgccaatatattgcccaccgataaacacttgtggcacgcttgttttgcctgtgattgcacgaacagaaattgtactcgcatcacgacccagtatgatttcttcaaaggtatagcccttttcttttagcaatgtttttgcttttgcacagaatggacagccgggttttgtgatgatggaaactgaaggtttttctgtccaatttgggtttaagtatttaatcattgtgtctgcatcagagactttaaatggatcgccaggttcttgtggttcaataaacattttttcgactacgccattttttaccagcatagaataacgccaagagcgtttaccgaaaccaagttctgttttatcaacaagcatgcccataccgcttgtgaattcaccattaccatcgggaattactgttacattctcgctttcttgatcagctttccaagcattcataacgaacgtatcgttaactgatacacaaataatatcatcaacacctaacgctttaaattcacatgcaagttcgttataacgaggtaaatgtgttgctgaacaagttggagtgaacgcacccggtaaagaaaataatacaaccgttttattgtcaaacaaatcggcggttgtaacatcagcccattgatctccttggcgtgtacggaatgttacttgaggaactttttttccttccatagtcataattttttctcctatataaagattagttgataaaaaatatgattttaagtttaaactatgttatagtcaaaaacaatcaaaaaaagttatttaattgttaatttctatgataggtgtacagaatgaatattcgagatttagaatatctagtttctttagctgaacataaacattttcgtcgtgctgccgatgcttgttatgttagtcaacctactttaagtgggcaaattagaaaattagaagatgagttgggtatcgtattactagagagaacaagccgaaaagttttatttactcaatctgggttgcttttagtcaaacaagctaaaactgttttacgagaaataaagctattgaaagaaatggcaagtaatcaaggtaaagaaatgaatggaccactacatatgggtgtcattccaactattggaccctatttattaccctatattgttccggcactaaaaaatacttttcctgacctagagctatttttgtatgaagctcaaacgcaaaagcttttagaacaattggaaacaggtcacttagattgtgtcatattggcatcagttgatgaggctgaagcctttattgaagtaccgatgtttaatgagagaatgctactggcagtttcagacgaacaccctttatcaaaagaagattcgataaaaatggataagctgaaaggatatgaaatgcttatgctggatgatgggcattgtttacgaaatcaagccttagattactgttttgctgctggggcaaaagaaaatcagaattttcgtgccacaagtttagagacattacgtaatatggtatctgccaatacaggtattactctcattcctgaactggcactcttaaacgaaggttcgagaaaaggaataaaatatctgccatgtttctctcctgagccatctagaggtatttctcttgtttatcgtccaggctctcctctaagagggcgatatgagcgaatagccaataaagttagtgaaataataaaacctttactaaataatagaaaaaacggtaattgaggtataacagctatataatagctgtataaatatctaattgtttggaaaaactaaaattacatcagggataattctgttggcttttaagtctgctatagcaattattaattccaatttgtttttaggctatttttttaataagtcacgaatctctgttagtaatttttcttcgtttgaaggtgtaattaccttttctacttttggttcttctttcttcaatttatttaatgctttgatcattaagaaaattgcaaatgcaataatgataaaatcaaatatattttggataaacataccatattttaatgtcatagccggagttttatcggttgcttcttttaaaacaatatgtaagtctttaaaatctacgctactggtgaaaaaacttaatatcggcatgatgacatctgctactaatgagctgacaatcttaccgaatgccccaccgataatcacaccgacagccatatcgataacattgccccgcatggcaaactcacgaaattctttaataaaactcatcacatactcctaaaataaacaaatataagtttgaatagatcgtaaaaactttcagtttgatgtatagaaaattgatattattctctaaataaagaaagcattaggttgaaaaagtttctctatttctgttacatattttttatcacttaaataaacaatgacatgatcgccactttcaattactgcatcttttcttgcgatgatcacagtatcttgtcgcaaaattgcaccgataattgcaccattgggtaattttaactctctaagtttacgtccaattaattgtgatgttgtttcatcgccatgcacaataatttccaatgcttcagcaatgccatgacgcaaagagatcgcatttgcaatatctcctttacgtacatgccccagtaaagcggagatggtagcttgttgtggagaaactgcaatatcaattgttccgccttgaactaaattgatgtacgccatacgctgtattaacaccattgcttttttagctccaagatgcttagccaagaatgccgacataatatttgtttcatcatcactggttaaacataagaaagcgtcaatgttttcaatatgttcttcaaacaataacgatttatcggaaggatctccatgcaatactaaggttttagataatttttccgcaagtgatgttgcacgctctgcattacgttcaataagtttgactgtgcagtgattttccagtttttttgcaacacccacggcgatattacctcccccaataatcatcactcgtttataaggtttttccaagcgttgcagttctgacatgaccgctttaatataaattgttgcacaaataaaagttacctcatcgccggcttcaataattgtcgaaccctgcggacgaatcactttatcttgacgcaaaatagataaaatacggcaatcaatatgcggcatatggtcttttagggcggaaagagaatagccaaccaaagggccaccataataggcttttactacaacaatactaatattttcattagctaaatgagctacttgtaatgcaccggggtaatcaattaagcgagagatttcttcagtaacaagttgttccggtgaaatgatatgatcaatagggatcatgtgcggttgaaataatttatctttttcacgccaatattctgcatcacgaatacgtgcaatttttgtcggagtgttaaataaggtataagctatttggcaagaaatcatattcgtttcatctgaacttgtaacagctactaataaatctgcgtcaggtgctcctgcttctcgtaaaattctcggtgatgatgcagagccgttaatcacttttaaatcatgtttatcttgtaaatgtgccaaacgaacagcgtcattatcaattaacgttatatcattgtcttcactcactaaattttcagcaagtgttgttcctacctgaccggcacccaaaataataattctcatcaattccctcttttaatttatacagattgaatacctttatttttcatatttcaacttcacattaatttctgataagttttatgattaattgggcagttttcttaatttggcataataaaaaccgtcacctccctgttctgttggaacaaattgatgaccaatttcctccccaatggtaaaaggcaaaggttctaattttgcatcattatgcttggctaagaaatgctgaatttgttgactattctcttcaggtaataaagaacaggtcgcataaactaaaataccttgtggttttaattttttccaaagggcttctaaaatttgtccttgcaattgcactaggggagtaatatcactttcttggcgtagccattttatatcagggtgtcgacgaataacaccggtagcggaacaaggagcatctaataaaattcggtcaaattgcaccgcactttcagatttaaaggtcagtcctatagcattaaaatcaatctctgataaccattgcttcggctgggttgcatcaccacaaattattatagcttgttgtttcatacgaactaaattttctttcacacgttgtagacgagcaggttcaatatctaaagcgatgacttttgcgttgggtgcttgttctaaaatatgtgtagtctttccgcccggtgccgcacaagcgtctaaaataagttcgttattttccggttcgagtaataaggctgaccattgtgcgtgtagatcctgaacgctcacccatccttgttcaaaatagggtaataaattgaccgcacttgcttgatgtaggcgtaatgcttgtgggtgattcgttgttgatgtagatattcctcgctccattaaaagttgttgataatccgcaatagaacaatgttgtaaattaatgcgtagccacatcggaggtttttggttatttgcttcaacaatttcacgccaattggcataagattgttttagtttattcactaaccattctggatgtaaggtttgccaatgcttatccactatcgccaaaatttgttcttgttctcgcaaaaagcgacgcaaaacagcatttaacaggccacggaaactatcggattttaaacttttcgtggcagaaacgacttcgtccactgcagcatgagcaggaattcgggtatataaaatttggtataaaccgaccaacaacaagcagtgcacgatccgagttttacctttcaaaggcttatccagtaggagttgaatgatgcgttctaagcgaggtaacacacgacaaataccaaaacaaatttcttgtagtagcggaaaatcttgcggtttgaccgcactttgttgctcaggcagcaaggtagaaagggatttaccttgaactaaaacttgtaaaattacttctgccgcaagcacacggactgagcgaggcgtgaaaagtgcggtagatttgaccgctcttttagttttgttgtgctgagatttgctcataggacttgtcctatcttaaaccaatccgcacggctgtttaataaatctcgtgctgacatcggttttttacctgcaggttgtaattgctccaagtttaatacaccatttgctgtcgctacttgaatacctcgtttatctgctgcaagaatggtgccacaaggcttattttgatgaggtaacactgaggcttgataaacttttaacgtttgtagcgtgccttgactgtcttgtgttacaaaataactcattggccatggattaaacgcacgaatacaacgttctaattgttcagcggataaagaccaatctagtttagcctcttctttagaaagtttttctgcataattactcagactttcatcttgtacttccgctttaaatagaccttgttctaaaccgtccaaaacctcaagtaaggcttttggtgcaatgttagccaatttagtgtaaagggaggttgaggtttctgtcggtgtaatatcacaacagactttatgtaacatatcgcccgtatccagcccctcattcatttgcataatggttacccctgtttttttatctcctgcccaaattgcacgttgaataggtgctgcaccacgccaacgaggtaaaagcgaaccgtgtacattgagacaacctaaaggaaatgtttgtaacacagccaaaggtaaaattaacccataagcaacaactaccatcacgtcggcattcaatttactcagatgttcttgcacctcaactttacgtaaggatttaggttgataaacgggaatatgatgtttttcggctaaaattttaaccgcacttgcccgcaatgtttgccctctccctgcaggtttatcgggctgcgtgtaaacagcaaggacattatgttgagattggagtaacgcttgtaaatgttgtgcggcaaaatctggtgtaccggcaaaaataatatttaatggtttcataagataagctaatgttctacgttatgtaattgataaaaataaaaggcggacgatccgtccacctattgtttaatttaacgattttttgcgatctgtttttgcaatttgagtagtttttctttcatgcgttggcgttttaatggcgacaaatgatcagcaaaaacaataccatttaaatgatctatctcgtgttgaatacaaatggccaacaaaccatctgcatctagcataaactcttctccctgacgattttgtgcttttacttttacagtctctttacgaggcacaaaaccacgtaaaccaggtaatgataggcaaccttcttcaatacctgtttcaccgaaactttcaagaatcttagggttaatcaacacaatttgattttctttagttccttcaatatcgatcgtgataatacgcttatgtacatttacttgtgttgcggctaaaccaatcccttcttcgtgatacattgtttcaaacatattatcaataaaggtttgtaattcttcgtcaaaaacgcttacaggttctgcgaccgtttttaagcgttcatcgggataaattaatacattcaataatgccataagttcctttcatattttatgttataaattcaaattgaattcattttactcgtttttataggcttttttaagaaataaaataaggaaatgggaaaatatctcaactgagatgcgtaaaaaacttcagcgagagcgatttaccggcaaaagagcggtaatttctaccgctcttttttgggaattgtgttatacgcctttatgttggaagtacaaaactgttgcggcaacccgagaatgaacgtttaatttacgtaataaattgcgaatatgtacttttacagtttcctctgaaataaataattgtcctgcaatttgtttatttgctaatcctgtcgcaatgagtgccagtacattcatttcccgatctgtgagggaataaataggatcatctttatgttgacgttctaacagtaaatttttgatcgattcactgagaatgacttcgccttgtgtaactcgttttatctgagagagtagggtatccggttccgtatcctttaataaataaccgtcagctcctgcatcgattaatgtgcaaatatcatttttcgcatcagaaacggtaagtattagaattcttgcatcaattccttctgtgcgtaaagcctttaatgtatccagtccggataatcctttcatatttagatctaaaatgatcaaatcaggttctaactgcaatgctagatttacaccttcacttccacttccggcgtcacctatgacttcaaaagattcatccagctcaagcaattgtttaatacctcgtcgcatcaaaggatgatcgtctattaagagcacttttgttttatcagacattgattttgtcctcatcatgagagtgcaaggcggctatgaaaaggcacgatttttgttccaccgttgcagtccggtaataattgataaaattgcggatagttaaaattatgctgcacgattttatatgggttgttgtttttatccaagctcgccgattgataaatttgatttatctcacgaattttctgttcttttgagccttcacaatgtcgatagatttcaatgtggttttgttcgtctaaaatatagacattaaaacttttatcttcattatcttcaaagaaaaattgtaagaaaccttcgctcgcaaaagcatccatttcataaggataatgtttctgttctgctaaaagtgcggtttctttttcctcaatagtattacgtagttcattatcaaatacactattatttatcgaagtgttttgcatttcctgtaagctgagtccacgctcttcaaagaataattgccagtttttacccgctattctcaacatattattttggggggcatcggtatcaccaattcgtatatcaatatattttttgataagtgcatggacaatattgcataaggttttttggtagtgttggctgtaacaaaagacgttaattgattttggcggtgttgagccgggataaattttgtttgataacacttttaatgctaatagaatggcattggcaccctcaaaatgcaacgtgcggatttcattccagatatttctataagtgaggtcaatacttcctacgagactttcttctgaaggcccaaaactgaataagtcacttggtaaaatagtcgacttactttgcaacaaatgagcagttggatcattagttaaattgattgtaacggagagatgttttattttgcattgttgagttaattccttatttgttgcttttttagtacgggtaatagggaaagataaacgcaaatcagcaacgaaattacgtagcgttttaagagatacagtatcactatgaatataaagcgaagtgattggtgtaagcaacccattaaaataggcccatgaaactaatttatttagattttcgccatattctatgtggcgtttttgacaaagtccttgtacatccggtttttgtgttactaaataccaaccggctttgaagaatttattttgtttcacttcaatgaatgttaagtgcggttccgataaatcaagggaaatagcttgattgagcaaggtgatttttcccggtaattcttcaaaagcagtgtaaagttttctggtcaagatagaaacatcttgtggcatgatactggcatttacattatgtttacgcccgaagttaattagatttcgatagctcaacataaggtattgcatcaggtcattgtgactttccttaacttttttgattttccaagttgtacgttgatttagattttgaagaagattatctgaccaattccactgctgtgtaagttgatgcagtttttctgaacgccaattattttcttgttgttgaacgatatactcactggctttcatataaaagcaacgtctcacaaaatctaatcttttgaattcattcagttttgttaaaaaagaactcactcgctccaacattgctaagtatgggtcatagtgatagtcaagatcgttattcagcagacgttgtttgaattcttgtgcaattaaatgagtatttggatattcataagaataactttcgagtaataagattttgagtaccgatttatagggggaatcgatacctttatatagttgccatagacttgcaccaaaatattcgttcgctgaaaacgcactcagacaaccaaaatctacccaatcatctatattgatttgctttgttttgatgagtcgattgacttcagaactataatcttgttcatttgctacctttagatgtaaccaaagtagcggtttaccggcaaggcgaataacagaacgatagaactcctccagtaataacatatattgtgcggagccactattttcagaagtaagtgcatcggcataacgaaagctacgaaaacgctgttggtcaattaaataaagattaatttctacgccaagacttcttgcccattgttgcaataagtgatttttttttgaaagttgttctttatcttctaagctaagatcttctcggtggcatacccaaatatctaaatctgagcttggtgtttggctgatagaaccgatacttcccataacgtaaacacctaaaataggcgtgtctgtgagatgttgtaatgctgccaaatgtgtactaagttgctcaaaatctccctgagggagatgtgtagttaaaaattcctgttggtattttgataattgaaaacgagcaatgccatgtggggcattcggtaggtaaccgcccatcaagggatgatttatgtgtaacaataaggtaagaagttgtaatacacgttggaactctactgaagttgaagatagtgctctttctaaacgtaactgatcaacaaattcaacttgtttcttcgcttgttggagatcgtatttcaagttattctctatctagataaattaatcgttgcttactctatcactccccttgtatgaaagcaaaaaaatcgagtaaaaaattaaatctacactgacatttcagagtaacagtgataggatattgcgattacgagtctaatctatatttctacatatgagtatcaacaagaccctaaaaattgcgacacgtcaaagtccgttagcattatggcaggcaaattacgttaaaaatcgcctacaacaacgttattctcatttaagtgtcgaacttgtccctatcatcacaaaaggcgatgttatcttagatacacctttagctaaaattggcggaaagggattatttgtaaaagaattagaaaatgcgttgttaaatggtgaagcggatattgcggtgcattcgatgaaagatgtgccaatgcaatttccgaaaggattagagctaagtgtgatttgtccgagagaggatcctcgtgatgcatttgtttcaaataagtaccgcactttagacgagttaccgcaaggtgctattgtaggaacatcgagtttacgtaggcaatgccaactcaaaaactggcgagcggatctcgatattagttctttacgtggtaatgttggaacaagattaaataagttagatcagggtgattatgatgcgattatcttagcttcggcaggattaattcggttaggattgactgaacgtattcgctcttttattgaaattgatacgattttacctgcttgtggacaaggtgcggtaggaattgagtgtcgggtagatgatcgagatgtgcaatctttattgatgccgttggctgatcagacgaccacttattgcgtattggcagagcgtgcaatgaattttcatttgcaaggtggttgccaagttccgattggtgcttatgcaattttagagaataatcagttatatttgcgtggtttagtgggagatgttcacggttcacaaattctatcggcagaagggcaatttgaattatctcttgattttgaatcatcgcaaagtgcggtgcaaaaagcggaagaattaggcgtgagtattgctgaacaattattacagcaaggtgcagataaaatcttacaggctgtttatcaatcataattgagtaagaggcaatggcagttttaattacacgacccggtgagcgaggagagcggcttgttgagatgcttaataaagccggaattatggcactccatttaccgcttatttccattatagcggggcaagaattaaatcgattacccaataaattacaacaattaaattgtggtgattatgtagttgcagtatctaaaaatgcggtggaatatgcacaaaaaaccttaagtgcggtaggtttttgttggcgttcggacttatattactttacggttggacaacgaactgcagaatattttgcgagccaaatagaaaattcggtgtattatcctgttgagcaagaaagtagtgaaggattacttaatttacctcaaatgcaagaccttcaggcacggaatattttgattttgagagcgaatggaggacgggaattttttactgagcaggctattttgcgaggagctaaagttgaaactctggaatgttatcaacgaatgcccattgaatataataagttggaaaaaattagtttatgccaacgtattggggtagataccattgttgtaacaagtcaagagatgttaaattacttagtgaaacttgtgccaaccaatgaaacaggctggttattcagttgtcgtttagtaacggtaagtcaacgtatagcgacattggcaaaaagtgttgggtggacaaatattgttgtggcagataaagcggataacttgagtcttttccttgcattgcaacaatgaaggctggaatttcatttgattaaggaataaaaattatgacgaagaaacattcaaaggttagcacagaaaaacaggataatatatccgtgcaaaatcctcctttggaggcagaattgcaatatgaggaagtaccggctgaggatattgtaaagcaagaaagtaaggctaaacaggaaactttttcaaatcaggagcattttatggaaagagagaatgaacaagttggcgaaaaaagaacagcagctcaagttgaaactgtagtggtgaaaaaaggagggacagtcattgctctattagctttgcttattgcattgggtattgggggagctggctattattttggtcaacaaaaagtagaagaaattcagcaaaagttgaccgcacttagccaaccgtcggaagctgtgccgctagaaaacaatgatactttgttggtaacagttgaagaatataagcaaacttttatacagaagattgagcgactggaaaatgaaatgacaaaacaaaaccagcttattcaaagtttacaagcacaagtaaataaattggatgcggttggtaaagttgaacaatcgacggattggttgttgtttgaaacagattatttgttgaataatgctttacgtaaaatcgtattggataatgatgtggagacagctattgcgttattgaaagtggcggatgaaactctcgttaaggttaatgatcctaaagtcattaacattcgtcaggcaattaatgcagatttaaaacagttattatcagtaaataatgtagatcaaaatgccatcatgcaacatttatctcaattagcaaacggtattgatgaattagttgtattaaatgtgaatttcgatgagcaagaaaatactcaattaagcgattccttacaggattggaaagaaaacgtagaaaaaagtgcggtatcttttttaaatcattttattcgtgtaaaacctcgccatgtgaactcaaaggaattacttgcaccaaatcaagatatttatttacgtgaaaatattcgtttacgtttgcaaattgcgattatggcggtccctcgtcagcaaaatgatttatataaacaatcacttgaaattgtaggttcttggataagaagctattttgatacaagcactgaagtggcacaaaacttcttgaaagagattgatgaacttgctgagaaatctatctatgttgatgttcctaaccaattaaaaagtttgcttttgttggataagttattgaataaggaacagtcatctgtacaaaaaattgaaatgacagtagataaagacttggttagctcaacagatcaagtatctgaggaagggaaaacagatcaagctgttgaaaaatctgatgaaaagccaattgaacagcctgttgagcaagcacagtaataggagaatagcgtatgttcagagttctatttttaatgctggttttattggctggattaattggcggtccctatttatcaggtaaacagggatatgtgttaattcaaacggcaagctataacatcgaaatgtcaatcacgatgttggttattttctttgtgattttaatggccattgtttatctgattgaatgggtggttacacgtttcttccgtttgagtaataatacctatagttggttctctcgtcgtaaacgtgttaaggcacaacgtcaaactttggaaggcttagtgaagatgaatgagggcgattattccaaagctgagaaattgattggaaaaaatgctagacattcagataaaccaatattgaatttaattaaagcggcggaagcggcacaacagcgaggcgatgattttgttgccaatcgctatttaattgaagcaacagaattagcaggtacagacagtttaattgtcgaaattgcacgtactagaattttattgcaacaaaataaacttccggcagctcgtagttcggtggatagtttactggagatgacctctcgtaataaagaagtattaaagctggcagtgaaaatttacctgaaatctgccgccttccacgcattggataaaattctagatcaaattgaaaaagttggattatattcttccgatgaattcaccgcccttcagcgtaaagtcgaagatggtttattagacgagaaaatgaacgaagagggtgttgatgggttattacgttggtgggatgaacagcctcgtaaacgccgtaatgatttatatgttaaggttggtttaattcgtcgtttactggacagtgatgatcatgaaagtgcttatgagttagctattgatgctctgaaaaaagttgaaaatagtgttgaagctaatgttgctctttgtactcaaattactcgtttacaaccggaagataacagtaagttattaaaacttttggaaaaacgtgcaaaacagtcaaacagtaaagattgttgctgtgttgaacgtgcgttaggttacctttatgtgcgtaatgatgatttcgctaaagcggcagaagcattcaagaaagtgatagagaataaagcgagcttacaagcaaatgatattactatggcggcttatgttttcgaacaggttggagagcttgaattagcacaaaaagttcgtgaggaaggattgagaaatgtgatgtcaattaaagagtcggaaaataaaaccaaaaaaacagcagaaaatccgaccgcccttttagaacaaaaatcctaaatatattgttaaaaatgcccttaaaaatcattgttaagggcatttttataggttttatttttcctcaatgaaagttaaggctttttcaataacctccacaccggcatgagatttatggatgttttcactcatatagcgtcgccattgccttgcccctttacattgttgaaatgcacctaataaatggcgagcaatatgattaagataaacgccttgactcaattgttgctctatgtaaggaaacatattttctattgcttgtcttggcgtgataattgcacaagacggatcaaataacgcttgatcaatatagcccaataaagacgggttttgataagcttcacgcccaaccattactccgtccacataattgagatgttgttgaatttcttcaagcgttttaattccgccattaatgctgatcaataaatgaggaaaatcctttttcaactggtaaactcgctcataattaagtggcggaatttcacgattttcttttggacttaaccctgatagccatgcttttctagcatgaataataaattcttggcaaccgatattatgtactttttcgataaaatcacatagaaattcatagctatcaaactcatcaataccaagacgagtttttactgtgactggaatattgaccgcactttgcattgcgttcacacattctgctactagagcagcccttgccatcaggcaagcaccgaacataccattttgcacccgatcggatggacaacctacattcaagtttatttcttgatagccacgttcttcagctttttttgcacaatattgcagtttttcaggatcacttccgccaagttgtaatgccacggggttttccgatacatcataagcaagatgatcgtatttggcgtgaataattgcaccggtagtaaccatttctgtatagagtaaggtataccggctgaactgccgatggaaaaaacggcagtggcgtgtagtccagtccagcataggagcaacggaaaaacgacctcgataaaagtgcggttgattttgcttcattttttacttgtttgataattgaaacggttagggtttagcgttttcgtgagcttttctctttttgtgcatgccgacggaaacgcccacgcccaaatgataaagtaatacaggattaatttggcgtgaaacaaaagccgttacaatacaatcaatgaatgcttaaatcaagccaatttgatgagttgttattgttggtttaaggattgcgtacttaccactcaatatctgagctaatacggtatgtctaagagggaataatcgggttattgcttagatttaatatgaaaggtaatttcatgaggtgaagaaattccggtagattttagtcacttgactagaaaagtgaagtagcaacgtaaagaaaaattggtacactctttttaagtttacgttgctgtcgttttagatatttatttaatcccaggagctttccaaagcgaaatggttagtcctctgtcaaccaatttcaattgctgctggtatatttcttgccatttttctttatgtatttgatataaattatgatttcttgcatttggttgatgttgtctttcaaattttactaatgttttacctgcttcatgtaatgaagtataaataccagcacctactccagctgcaatggcacatcctagagcagttgcttcttttactacaggtacattaacaaccaatcctgttacatcggctagaatttggctccataatttcccttttgcaccacctccggcaaaaacaatactggtaagattaacttggctgaattgctggacttgatcaagattacatgaagatacaattgctgcattttcttgtaatgctctaaacaggactgatttgttacatttttcaggatcaatcgaaaggttaataaatgatggggctgcgtgataccaagatttgaaatgcatagcatcagagaatacaggaataacatcatttgaacctacgggtatcttttctgccatttgttccagtaatgtgtaagcatcaacacctaagcgatgagcgacggctttttcttcttcacagaaagcatctctaaaccaacgcatagtaagccctgtaaagaagctgatagattctgcttgtaccatcggtgcaatgacatgcggattgatgcgtatattcattttaggatctgtcattgcttgtggtaagtttacgacctgttgccagaaagttcctccaataatagcagcttgccccggttctgtaatccctagtccgatacaacctaattgcacatcaccaccaccaacaacaataggcgtgccgactattaacccggtttgctgtgcagaatgggcggttacttgaccgagtatttcacctgtctcttttactttcggtaaaatagcaggattgagtccagccatctctagtaaagtgtgctcccattttcgggtttttaggttgagaatgccggttgtgccagcatttgaaggttcgacggccagttctccgctaagcataaatcctaaccaatcgctaatcatagagagaaaatggacttgagcataaagattaggttgatgatgtgcaagccaaagtaaacggggtaatgcacttaatgccagtgtttgaccggaggattgataaacttgttgttcaaactgatactggtttagagactttaattgaataacttcttctacagatctggcatccacattaccgcacgcccaaatcgggtttttattggcatcgtataaaacaatgccttcacgcatggagcaagtcgatatagctataatttgtttagcatctatttggctggtagctaaaacttcttgaatacataagcaagcaaggtgccagttattttgtaaatcaaagcccattgagcctgggatatttgggtcggaaatatgtgtccattctttttgtgacgtagcgatttgatttccttcaagatcaaaaataactgcacgaatactacctgtgccggcatctaatgccattaaataacgggataattgcattatgttttcctccgattatctgaggaaaatcgttacactactttagctaaaatagtgcgtgcggttttttcctctgtgactaatgaattgatatgctgtcctaaaagtgcggcaataattgcttcaactttatcttcaccaccggcaacgccaataatagtcggtattcgcttgatactatctaatgaaacgctgattaattcttcgtgaatcggcatatccggttgaatgtttccattttcttgcaagaaatagcctaaaatatcccccacagcacctttttgacgaaattcatctagttgtttttcattgatgatataacctgtttgaagcaaagtggagcgtgttttctgaaccgtagatccgataccaacgatggcaacatcagccatactggctgctaacataatatctcgtacatacccctctttttggaaaagttgtgcagcttcaggtgaagaagctcgtagaggggcgggaataatactgatagcacagctactatcaagctgcccaatactttgcatataaggtccaacaccgccggttaaggtgattaacttaatctggttttgtttaataaaatcattgcagtgctttaccgtgtgcatcacagtgtcaccaaacccaaaagagagaacttgcttcgctttgagtaatcccatcaacatttgagaggctccgacacctaagcgggcattgacttcataattctgtaactctggcaacacacgaatatgctgtaaatgaaaccgctgttttaaagcttcttctagttccaagcatcctttataacgagagttgatttgaactttgattaagccgatttgtcgccctttttccagtaagcgtgaaacttttaaacggggcaagcccaatttctcaccaatttcattttgtgtcagattatcgtggtagtagaaccatgcaatgcgtgctaataactcttcctcgttaaagcccgcctcgtagtgattatctaaatttatcatttttttaccctgtttttattattcatctgattttaattttaatcaaatgttctttttctaaagtgtgaattcgatcacattttacatttaatgtgaaaaaaagacataaaattcttaaaaatgtgaagtttatcacaaaaaaatagaattttttgggttatgatttggaacaaatgataattaaaattttcatttgttcaatttgaagagtcaaaaatgaaagagacagaatctaatcctacacctttactggaagcttgtgatgtaagtaaagctttctctggtgttgaagtactaaaatccattaacttttccctttattctgggcaggtacatactctactgggtggaaacggtgctggcaaatcaaccttgatgaaaattattgccggtattcagttgcaagataccggcacgttaaaaattcatggcaaagtccgaaccaatttaacaccaagcaaggcacatcaattaggtatttaccttgttccgcaagaacctttgttattttctaatttgagtgtcaaagagaatattttattcggtttgccaagaacaatggatttacagtcaaagctcacagcgttgttgacggaactaaactcacatttaaatttggatatgcaggctggtttattagatgttgctgatcagcagttagttgaaattatgcgaggcttaatgcgagatgctcagattctgattttagatgaacctaccgcctcattaacaccagtggaaaccgaaaatttattcggacagataaattccttactcgtcaaaggggtagggattgtttttatttcgcataaattgtctgaagtttggcaaattgctgattgggtgagtgtaatgcgagatggttacattgccttaagcgagccaattgacaagatcaatcacgacgatgttattcaggcgattactcctcgagctaaaaatgcatcattaacagaaagtcagcagttgtggttggatttaccagggcataagagggtgaaatcgaccgaatttccattattgacagtagaaaatttcactggtgaaggattccgagatatcaactttgaaatttatcctggcgagattttaggattagcaggcgtagtcggctcaggtagaaccgaattagctgaaacgctgtatggtttgcgtaaagccaaatccggtaaagtgatattttgtgatgagctaattaattcactgtccgttaagcaacggcttaaacgaggcttagtgtatttgcccgaagataggcaagcctctggattgcatttagattcaccattaagttggaatacctgcggattaacctatcatgatatgggcttttggattgatgagtccaaggagaaagcaattttagaacgctattaccatgctatcggaataaaatttaatcatgttgagcaatcggtacgtaccttatcaggtggtaatcagcaaaaaattttgatcgcaaaatgtttggaagccgatcctcggttgttgattgttgatgagccaactcgtggcgttgatattggtgcgagagcagatatttatcaattaataaaaagtattgccaaacaaaatgtagccgtgttgttcatttcatctgacttggaggaaatagaacaaatgtctagtcgagttttggtaatgcacgacggtaagcttagtcaatcgttgaaaggtgaagatatcaatactgataatattatgcgactggcattcagtagttaggaggcattatgtggaaatttattcagaacaatcgtgaattaactattttagctgccattttgttgttatttggattgctaggtgtggtggatgactttagcttacaaactctcatgatgatttttaactcgacccaaatattagctttgttagctattggtgcgacctttgtgattttaactcgtaatattgatgtctctgtcggctcaattatgggattaagtgcagtagttgttggattagtgctaaattcaggttattccctactgattgcgtgcactattactttactgtgcgggattattgcaggtggggtaaacggtgtattagtctcagtacttagaataccggctattgtagcgacattggggacattgggtttatataaaggcttaatgttagtattaactggcggtaagtggattgaaggtttgccacattcattgaaaacattgtcagaagaaattgtattggggttttcgcctattgggttagctgttattttcctcattttagtcacgtactacttttttactcacacttatattggtcgttgtttttatgccgtgggggataatttacaaggtgccttgcaattaggtgtaaaggtgaatgttattcgcattagtgcatttgcagtaaacggtctaatggctgctttagctggaattatttttgcctctcaaatcggttttgtgccaaattcaactggtaatgggctggaaatgaaagcaattgcggcttgtgtattaggtggaataagtttactgggtggtgcaggtaatattattggtgctgtattaggggcatatttcctgattcaaattgatacgattttagtactgatgaaagtgcctgcctattggaataactttgttgctggtgtggttctattagctgtattggtatttgacggtagaatccgagtaatgattgtcaataatatcaaacaacagcgttatgcccgttttcttaaagataattcattgtaggagaatcaaaaatgattaagaaatacaactgggaaatagctctcttttgtctactgatactggaaattatcgggttcggtttggttaatcctcggttattggatctcaatgtcttatttaacagcaccagcgattttatttatatcggaatgttagcattgcctctaacactgattatagtcagtggagggatggatatttcatttggatctgtggtgggactatgtgccattactctcggcgtattatttagactaggaataccgttaagtgtagcaattgcggtgacatttgcagtcggatcattgtgtggtgcgattaatgctgtactcattatctatactcaagttaacccgctggttattacgcttggcacaatgtatctgtttggtggtggtgcattgttattatcaggttttgctggtgcaacgggctatgagggtattggtggatttcccgatgtgttacttgattttgcaaatttcagttttggtattattccaacaccgattatttatttcttaataatgacattactgttttggctgttgatgcatcgtactcgtattggtcgtagcacatttttaattgggcaaaatttacgggtctctaagtatagtgctgtaccggttaatcaaactctatttattatttatccgttaattggtttgattgcggcttttgtcggtgtgttgctggtatcctactttggttcagctcgttcggacttagggagttcgttgttaatgccggcactaaccgcagttgtacttggcggtgcgaatatttacggtggttcaggttcagtgattggtacagcaatagctgcattattgattggctacttacaacaagggttgcagatggttggaatttcgaatgaaacatccagtgccttgtccggagcattgttgattattgtacttatcgggaaatcgcttaatacacatcgggcagtagtgattcaatggtggaatcgaatccgagcagtttaaaataagcggttagtttatgatgatttttgtcaaaattgactgcgataaaacccctgcatacttgttgttttggtatgttttttaatcatacactcaattgaggagacgttctatgaaatactcacttttaaaaacaaccgctcttgccgtagcgttaggttttaccggttttaacatggcacaggctatggataaggtggcatttatcccaaaattagttggcgttggtttttttaccagtggtgggcaaggtgcggtcgaaatgggaaaaaaattaggtttggatgtaacctatgacggtccggcagaaccgagcgtatcgaaccaagttcagatgatcaataactttgtgaaccagggttataatgccattatcgtctcagcagtatcgcctgatggattgtgctctaccttaaaaagagcgatgaaaaaaggtgtaaaagtattaacttgggactccgatactcagcctgagtgccgaagctactatattaatcaaggaacacctactcaacttggctcaatgctagttgaaatggtatcaagtcaaatttctaaaccaaaagcaaaagttgcatttttctattccagtccaacagtgacggaccaaaaccagtgggttaaagaggccaaagcaaaaattgaaaaagaacatcccaaatgggaaattgtgacgacacaatttggctataacgatgcaattaaatcactgcaaactgccgaggggatcttaaaagcctatcctgatttagatgcgattattgctccagatgccaatgctttgccggctgccgctcaagcagttgaaaaccttaaacgacaaggtacaatcgttgtcggattcagtacgccgaatgtaatgcgtccttacgtaaaacgaggcacagtaaatcagtttggtttatgggatgttgtgaagcaaggtcaactctctgttgcagtagctaatgaattgttaaaaggtaattctcttaaggttggcgataaattgaatgttgatggtattggtgaagtagaagtatcagcaaataaagtacaaggctatgagtttgaagcaaagggaaacggtattgtgttactacctgagcgtgttgtattcactaaagataatattgataactatgatttctaattatataggagacaatctatggcagatttagatgatattaaagacggtaaagattttggtattggtattcctcaaactaacaagctttttttcgtcaaaggttccagtgcattagattggggaatgcaatcacgtcttgccaatatctttaatcccaaaacaggtaagacaattatgttagcctttgatcacggctatttccaaggtccgacgacgggtcttgagcgcattgacctcaatattgcaccgctctttgattataccgatgtattgatgtgtacacgtggtattttaagaagcgttgtaccgccggatacccggaaatctattgctttaagagcgtctggtgcaaattctattttgacagaactttctaacgaagcagttgcagttagtattgaggatgctttgagattaaatgtatccgccatggctgcacaggtttatatcggttctgaatatgaacatcaatcgattaaaaatattattcaattggtcgatcagggtaatcgctatggaatgcctgtgatggcagtaactggtgtagggaaggatatggctcgtgatcaacgctacttctcactttcgactcgtattgccgcagaaatgggggctcacattattaaaacttactatgttgataggggatttgagcgggttacagcaggttgccctgtaccgattgtaattgctggaggtaaaaaattaccggaattggatgctcttgaaatgtgctatcaagcgattgatcaaggtgcagctggtgtggatatgggcagaaacatttttcaatctgaagcaccaattgcgatgatcaaggcggtgcaagcggttgttcacggtggagaaaatgcaaaagatgcctaccaactctatttaagtgagaaaaacaactaagttaattaggttggctaagttagccaacctatttttcccatgttttctatgataaggagaagcttatgtttgctatgcttgttgaaatcaatataaaagaaggtaaagaaaaagaatttctggaggttttcgaacgtaaccatattggcactcgccaagaactgggaaatttgcgttttgacatattacgagatccggaaatacgaactcgtttttatgcatacgaagtgtatgaaaatgaaacagcactaaattttcatcggcaaactgaacattatcgccgttgtgtaagagaattagaatctttaatgactggttcaagaagtaagaaaatctttgaatggatattaccgaatccttatgtctaaattatcacttattcagcagttaaagcagcaaaaactgagtgttggtatcttatctgcaaattggcttcaacttaatgaagaggtaacaacattgttggagaatcagattaatgtactgcacttcgatattgctgatgggcaatttagttcgttatttacagttggagcaataggaattaaatattttccaacacattgttttaaagatgtgcatttaatggtaagaaatcagttggaagtagcaaaagctgttgtagcaaatggtgcaaatttagtgacattgcagttagagcaatatcatgattttgctttaacgatagaatggcttgctaaacagaaaacaacttatgccaatcaggtatatcctgtattaattggagcctgcttatgtccggaaacgccgatttctgaattggaaccttatttggatcaaattgatgtaattcaattattaactttagatccgagaaacggaacaaaatacccttccgagttgattttagatcgtgtaatacaggtagaaaagcgattgggtaatcgacgtgtggaaaaattaatcaatatagacggctcaatgacgctggaacttgcaaaatatttcaagcaaggaactcatcaaattgattggattgtttctggttctgcgttgtttagtggagaattaaaaacaaatttaaaagtatggaagtccagtattatgtgacatcaataaaaagtgcggtgattatttcgtgatttttataaaataacttgctttttttgagatcatgagtataatctcaccactttcgatatgaaagtcgtttgatgtaatcatttattgaacgtactattacggtatgtaatagataaaatgtccccaatttggaggactaagtaggttcgctgcacttccctttatttaagatgttaaaggtgatggtgtcagtttttttatagctaattttattggagctctggtctaatgcagaaccaaagaatccgtatccgcttaaaagcttttgatcatcgtttaattgatcaatctacagcggagatcgtagaaacagctaaacgtactggtgcacaagtccgtgggccaattcctttgccaactcgcaaagaacgtttcacagtattgatttctccacatgtaaataaagatgcacgtgatcaatatgaaattcgcacacataaacgtttagtcgatattgtagagccaacagaaaaaactgttgatgcattaatgcgtttagatttggctgccggcgttgacgtgcagatcagcctaggttaattaagaggttattacaatgattggtttagtcggtcgtaaagttggtatgactcgtatcttcaatgaagatggggtgtcaattccagttaccgtaatcgaaattgaagccaaccgtgtgactcaagttaaaactcttgaaaacgatggctatactgcagttcaggttactactggttttaaaaaagcaagtcgtgtaaccaagcctgaagcaggtcatttcgtgaaagcaggtgttgaagctggtcgcggtttatgggaatttcgtactgagggtgaagaattcactttaggtcaagaaatcaatgttgacatctttacagatgttaaaaaagtagatgttactgggacatcaaaaggtaaaggtttccaaggtggtgttaaacgttggaatttccgtactcaagatgcaactcatggtaactctttatcacatcgtgtgcttggttctattggtcaaaaccaaactccaggtcgtgtgtttaaaggtaaaaaaatggctggacatttaggtgctgaacgcgttactgttcaatcacttgaaattgttcgtgttgatgttgaacgtaaattattattagtgaaagggtctgtacctggtgcaactaatagtgatgttatcgttaaaccagcagttaaagcataagtctaggagatagagatggaattacaagttgtaggtgcaaacgcactcactgtttctgaaactaccttcggacgtgagtttaacgaagcgttaatccaccaagtggttgttgcttatgcagcaggtgctcgtcagggttctcgtgcacaaaaaacgcgtgctgaagtgtctggttcaggtaaaaagccttggcgtcaaaaaggtaccggtcgtgctcgttcaggtgacattaaatcgccaatttggcgttcaggtggtgtgacctttgcagctaaaccacaagatcatagccaaaaagtaaacaagaaaatgtatcgtggcgcaatcaaaagtattctttctgaattagttcgtcaagatcgtttagtggttgttgaaaaatttgagatcgatgtaccaaaaactaaggttttagtacaaaaattaaaagatatggcgttaactgacgcgcttatcatcactgcaagtttagatgagaatctattcttagcggcacgtaacctttataaagttgatgttcgtgatgtgcaagctattgatccggttagcttaatcgcattcgataaagttgttgtaactgtagaagcggtaaaacaaattgaggagatgttcgcatgattcaacaagaacgtttgttaaaagtgttgagagcccctcacgtatcagaaaaagcaacaaataatactgaaaaatcaaatacaattgttttcaaagttgctttagatgcaaataaagtcgaaattgcaaatgctgttgagcaattgtttgaagtgaaagtagactcagttcgtacagtggttgttaaaggtaaaactaaacgtcgcggtgctaaaatgggtcagcgtagtgactggaaaaaggcttatgttactcttcaagaaggtcaatcgcttgacttcgttgaaggtgcagctgagtaatttcggaggagaaaaaataaatggctatcgttaaatgtaagccgacctccgctggtcgtcgtcacgttgttaaaatcgtaaaccctgaattacataagggcaagccttacgcaccgttattaggtaccaaatctaaaactggcggtcgtaataatttaggacgtatcactactcgtcatattggtggtggtcataaacaacattaccgtgtaatcgatttcaaacgtaacaagttagatatcccagcggttgttgagcgtcttgaatatgatccgaatcgttctgcaaacattgctttggtgctttacaaagatggcgaacgtcgctatattttggcacctaaaggtttatccgcaggcgatcaaatccaatcaggtattaatgcaccaattaaaattggtaactcgttaccgatgcgtaatattccggttggttcaacagtacataacgttgagttaaaaccaggcaaaggcggacaaattgctcgttctgctggtgcttatgtacaaattatcgctcgtgaaggtaattatgtgactttacgtcttcgttcaggcgagatgcgtaaagtattatctgaatgtgtagctactattggcgaagttggtaattcagagcatatgcttcgcgtacttggtaaagctggtgctaaccgttggagaggtgttcgtccaacagttcgtggtacagcaatgaacccagtagatcaccctcatggtggtggtgaaggtcgtaacttcggtaagcatcctgttacaccttggggtgttcaaaccaaaggtaagaaaactcgtcacaacaaacgtaccgataaatatatcgtacgtcgtcgtggtaaataatattaattaaattaagaggatatgccatgccacgttctctcaagaagggtcctttccttgacctacacttgttgaagaaggtagagaaggcggtggaaagcggggataaaaaaccaattaaaacttggtcccgtcgttcaatgatcattccttcaatgatcggattgaccatcgcagtccataatggtcgtcagcacgttcctgtttatgtttctgatgaaatgatcggtcataaattaggtgaatttgcaccgactcgtacataccgcggtcacgctgcggataagaaagctaagaagtaaggggtaaaagatggaaactattgctaaacatcgttacgctcgcacttcagcgcaaaaagctcgcttagttgcggacttagtccgtggtaagaaagttgcacaagccttagaaattctcactttcactaacaaaaaagcggcagctttggtgaaaaaggtgcttgaatctgcaattgctaatgcagagcataatgatggtgcagatattgacgatcttaaagttgcgaagatttttgttgatgaaggtccaagcatgaaacgtgttatgccacgtgctaaaggtcgtgcagatcgtattttaaaacgtacaagccacattacagtggttgtgtcagatcgataatagtagaggaataacaatgggtcaaaaagtacatccacatggtattcgcctaggtattgttaagccttggaactctacttggtttgcgaatacacaagatttcgctgataatttagacggtgatttcaaagtacgtcaattcttgaataaagaattagcgaatgcttcagtttcacgcattactattgagcgtccggcgaaaagcatccgtgtaacaattcacacagctcgtccgggtatcgtaattggtaaaaaaggcgaagatgttgaaaaattacgtaacgcagtagctgctattgcaggcgttccggctcaaatcaacattgctgaagtgaaaaaacctgaattagatgcaaaattagttgcaggtagtattgcttcacaacttgaacgtcgagtaatgttccgtcgtgctatgaaaaaagcagtacaaaacgcaatgcgtttaggtgctaaaggcatcaaagttgaagtaagtggtcgtctaggtggcgcagaaattgcacgttctgaatggtatcgcgaaggtcgtgtaccactacatacattacgtgcggacatcgattataacacctcagaagctcatactacatacggcgtaattggcgttaaagtatggatcttcaaaggtgaaattcttggtggaatggctgcaattgcacaacaaccggaacaacaaccagccacgcctaaaaaggctccacgtggtaaaggtcgtaagtaaggagatttgctaaatgttgcaaccaaaacgtacaaaatttcgtaaagtccacaaaggtcgtaaccgtggtattgctggtggtacagaagtgagcttcggtacctttggtttaaaagcagttggtcgtggtcgtttgacagcacgtcaaattgaagctgcacgccgagcgatgactcgtgcggttaaacgtcaaggtaaaatctggattcgtgtattcccagataaaccaattactgaaaaaccattagaagtccgtatgggtaaaggtaaaggtaacgttgagtactgggtagctttaatccagccgggtaaagtaatgtatgaaatggatggtgtatctgaagaagttgctcgtcatgcgtttgcattggcagcggcaaaacttccaattaagacaacattcgtaactaaaacggtgatgtaatgaaagctcaagaactacgtacaaaaactgttgaagagctgaatgctgaattggttaacttgttaggtgagcaattcaaattgcgtatgcaagcagccaccggtcagcttcaacaaacccatcagttaaaacaagtgcgtcgcagtattgcacaagtaaaaactgtattaaccgaaaaggcgggcgcataatgactgataaaattcgtacagtacagggtaaagtgattagtgacaaaatggataagtcatttgtggttgctatcgaacgtacagttaaacatcctatttatggtaagtttatccgtcgcactactaaactgcacgtacatgatgaacataacgaagcaaaattgggtgatgtagttgaagttagagggtgtcgtccactctccaaaactaaatcgcacactttagttcgtgttgttgagaaagcacaggcttaattgacaacgtatataagtaagaacctagcagaaatgctaggtttttggtttttttgatttatagaaatttttaaaattttactgcttataagcacgatatttaatataaattataactatattttaaaaatgattattgttttttagttttgtaagaaaatctgattctaaccttaaaattatttaaggataaaaaatgaaactatataaatttagaaaagaattatttgtattgactcttttagtctccggcaacagtatatcagcagagatcattgcggaattagatgaagttgtcgtatctgatagtagcagtgtagctgattttcaatcactcgcttttcaaggtggtcgtaaagctagtgatgtatttattgagggtaaagagtttaaaacacgttctgccaccttaggtaatgctttaaccggagaattgggcgtgcattctaacccctttggaggcggagcaagtgctcctgtgattagagggcaagaaggggtgcgtattaagcttttgcaaaatgggtcggatattgtcgatatgtctaatatttcgcctgaccatgctgtagtcgctgatacacttttagcacagcaggtcgaattggtgcgagggacatctaccttaatgtatggtatggcatcacctgctggtgtagtgaatattgtcgataaccgtattccgacttctcgtcctgagaaagggtatgagggagagatcgtttcacgttttgatacagcgagtaaagaaaaagtcttgactgccggatttaccttagcagcaagtgataatttgctgattcgtgctgagggactgacacgcaaatcagataattaccgtgtaccagaggtatatatcggcaaaaaattaaactatctgccggatagccatcataaatcaaaagtgggaacattaggagcgacatggataggcagtcaaggttatttgggtgcatcggtgagttatcgcaaggaccattacggtattcctgggcataatcatgcgtttgattattgttcaggacatttgtttgatactgataatttgagtgcaattacagggggggatggtgaagctccctatcttaatgcgtatcctcatttgatgacggatgaggatatcaatgcttcattgcatttccattgcggaacgaatcttgaaggaggtaagcatagtcatgataatatttatggacataatcatgatattagttcagcaggccccgtaattgacatgcgttctaaacgttatgatgtgagaggcgagtggaaagttccgttgcgagggattagcaaagtaaaattatctcttgcttatgcagattactatcatgatgaaaagcatgatggcaaagcacatattgataagaatgattcgcagggaacacaagcaagcaaaaaatatacagccacacttatgtcaggaaaaccggaggcattttattctaatcgtggatttaacagtcgtcttgagatttatcatcaaccaactgagcattttaatggcgtagtgggcgtgcagtatcaaacgcaaaaaactagtgttcagcgtttagccccaaatccaaacagtaatgaaaaagatttaagcggtgagagaaaagagtctgaacgtaacccattagttccgcatactaataaacaactgagtgtatttttattagaacagtttacttggcgtaattttatttttgagttgggtgcaagatgggagaagcagaatattcctattaactatgatcgaaataaattacgtcttgataaagcagtaggttctaaagttcgtcaaccggatttatctatttataaagaacatgctttatcttactcagggactattatgtgggattttcatccggattatcgactgtctatcataggatcgcataatgaaagaatgccatcaccgatggaactgtattatcatggcaaacatttggcaacaaattcttttcaatacggtaagaatgatttgaaaaaagagcggtcgaataatgcagaaattggtctgatgcgtatttctgataaatgggattttaaagtcagtgcttattaccaacgctttaagaattatatccacaatgagaatttgcatcgtgagggcaacttatttatgcgtcgatataacgaatcacaggcaagattctatggcgttgagggcgaaatcggttatcagataacgcctaatcataaaattacgttttttggtgactatgtgaatggaaggctatcaggctttaagaatttctatggtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaactatcgaacgtcccaaccgcaatgccgctcgtgttccaccaatgcgtttagggtttcgtttaaatagtcagtttaatgatcattggtccgcttcattggaatatacaagaatgtttgcacagaagagcgtttcaattaatacagtcattaaaacgattgatcgtgaggcagcagagaagcgaagagaaaatgcgaaagggcttgggattgatgagcattatcccgaacaagtccccgaagatgttacccaaggctatcacttgctgaatcttaccctgaattaccaacgtaaaataagtggagtagaatatagtgcgacactaagtgcgaataatttactgaatcaaaaaatctatattcataactcctacttgccttatgtaccgcaaatgggcagaaattttattttgaatgtcggggtaacattctagttgttcgtgaggatatcaaagagcggttgttttttgcaaaataaccgcagtatgttttctttaacgaaacctgttatctttttccaaaagttacttgataagtgcggtgctattgtgctaaactctgcgacctgtttaccatagggtagatgggttcgtcccgaaagggtgttttttattttaacggagcactaatatgatccaagaacagactatgctggatgttgctgataattcaggggctcgtagcgtaatgtgtatcaaggttctaggtggatcgcaccgtcgttacgctgctatcggtgatatcatcaaagttactgtgaaagaagcaattccacgcggtaaagttaaaaaaggtgatgtgttaaaagcagttgttgtgcgcaccaagaagggtgttcgtcgcccagatggtgcagttattcgtttcgatggtaatgcttgtgtgattttgaacaataacactgagcaaccaatcggtactcgtatttttggaccggtgactcgtgaacttcgttctgagaagtttatgaaaatcatctctttagctccagaagtactataaggagaaaatgtaatggctgcaaaaatccgtcaaaacgatgaagtaattgttcttgcaggtaaagacaagggcaaacgtggtaaggtaactaaagtgttaccaaacggtaaagtttttgttgagggtgttaatattatcactaagcacgaaaaaccagttcctgctttaggtaaagctggtgggttagtgaaaaaggaagcggcaattgatgtatcaaacgttgcaatctttaatccgacaacaaataaagctgaccgtgtaggttttagaattgaagatggtaagaaagtacgcttcttcaaatctaataatgaaattatttaaataactggagtaatgtgatggcgaaactgcatgattactacagagatacggtagtcaatgaattaaaagcaaaattcaactactcatctgtcatgcaagtcccacgaatcgaaaagattaccctgaatatgggagtgggtgaagcattgaccgacaaaaagttgctagataacgcagtagcggatttagcagcaatcagtggtcaaaaacctttagtaactaaggctcgcaaatctgttgcaggctttaaaatccgtcaagggtatccaatcggttgtaaagtaaccctacgtggtgaacgtatgtgggaattctttgaaagattgattactatcgctgttccacgtatccgtgacttccgtggtttaaacaccaagtcatttgatggtcgtggtaattacagcatgggtgttcgtgaacaaatcattttccctgaaatcgactacgataaagtagatcgtgtgcgtggtttagatattactattaccacaacagcgaaaagtgatgaagaaggtcaagcgttattagcggctttcaattttccattccgtaaataaggtaggttatcgtggcaaaacaatcaatgatcgcacgcgatgtaaaacgtgctaaattagctgataaattctacgaaaaacgtgaagaactaaagaaagtcatttctgatgtaaatacatctgatgaagaacgttgggctgcagtgttgaagttacaaacgcttccacgtgattctagtccagttcgtcagcgtaatcgttgccgtcaaactggtcgtcctcacggagttcttcgtaagtttggtttaagccgtattaaggttcgtgaagctgctatgcgtggcgaaataccaggtcttaagaaagcaagttggtaatttaccactttattttggaatcggagtaaaagcacaatgagtatgcaagatccaatcgcagatatgttgactcgtattcgtaacggtcaagctgcgaataaagttgcgattagtatgccttcatccaagctaaaagtggctattgccaatgtattagcggaagaaggttatattgctaacgttaaagtttcggaaggcgttaagcctgaattggaaattacattaaaatatttccaaggaaaaccggttgtagaaagtattcagcgcgtaagccgccctggccttcgtatttacaaacgtaaaaacgaattgccaaaagtgatgggcggattgggtgttgctgttgtatctacatctaaaggtattatgactgaccgtaaagctcgtcaagcgggcttgggcggtgagataatctgttacgtagcttaagaagagaggtaggaaaatgtctcgtgttgcaaaagcacctgttagtattcctgccggcgttgaggtaaaacttgacggtcagctactaacagtaaaaggtaaaaatggtgagttatctcacaccattcataactcagttgaagttaaacaagataataatcaattaacattctctcctcgtgtaggtattgctaatgctgatgcacaatcaggcacagcacgtgcattggtcaatgcgatggttatcggtgttaatgaaggttttactaaaaagttacagttggtgggtgttggttatagagcacaaatgaaaggcaatgtacttgtgctaagtttaggcttttcacatcctattgaccatgtgttaccagctggtgtaactgctgaatgtccatcacaaacagaaattgttctgaagagtgctgacaagcaattgattggtcaggttgcagctgatattcgcgcttatcgccgtcctgagccttacaaaggtaaaggggtacgttatgctgatgaagttgtacgtatgaaagaggccaagaagaaataattaaggtaacactatggataagaaatcagctcgtatccgtcgtgcagctcgtgcacgtcatatgatgagagagcaaggtgtaattcgtttagttattcaccgcacttcgcgtcatatttatgcacaagttattgcaccaaacggttcagaagtgcttgctactgcctctacagttgagaaagcaattagtgagcaagttaaatatactggaaataaagatgcagcggcagtggttggtaaaattgttgctgagcgtgcattagaaaaaggtatcaaaagtgttgcttttgatcgttccggttttaagtatcatggtcgtgtccagtctttagcggatgctgcccgtgaagctggtctacagttctaatagaggtaattttagatggcaagcatcgaaaaacaaactggtgaactgcaagagaagctaatcgcggtaaaccgtgtatcaaaaactgtaaaaggtggtcgtattatgagctttactgctttgacagtagtaggtgatggtaacggtcgagtaggttttggttatggtaaagcgcgcgaagttccggcagctatccaaaaagcgatggaaaaagcacgtcgcaatatgattactgtggctttaaatgaaggcacattacagcatccaattaaaggttctcacactggttctcgcgtatttatgcaaccagcaagtgaaggtacgggtatcatcgctggtggtgctatgcgtgctgtattggaggttgcgggtgttcgtaacgttctttctaaagcatatggttcaaccaacccaattaacgttgttcgtgcaactattgatgcattagcaaatatgaaatcaccagaaatggttgctgccaaacgtggcaaaaccgttgatgaaatcttggggtaattgatgatggcaaaaactattaaagtaacacaagttcgtagttctattgctcgtttaccaaaacacaaagctactttacgtgggctaggtcttcgccgtattaatcatactgttgagttaattgatactccggctatacgcggtatgattaaccaagtttcatatatggtcaaagtggaggagtaagagaatgcgtttaaatactctatctccggctgaaggtgctaagcacaatgcgaaacgcctaggtcgtggtattggttctggtttaggtaaaacaagtggtcgtggtcataagggtcagaaagctcgtactggtggcggtgttcgtcgtgggttcgagggtggtcaaatgcctttgtatcgtcgattaccgaaatttggttttacttcaatgaaatcagctgtaacagcagaagttcgtttgaacgacttagccaaagtagaaggtaatattattactttagatacattaaaagcagcgaatgttttaacaaaggatatccgctttgcgaaagtaatccttgctggtgaagttaaaactgcggtaaccattcgtggtttaggtgtaactaaaggtgcaaaagtagctattgaagctgctggcggttcaattgaggaataattaacaaatggctaagcaaccaggttatcaaaatagaagtactcaaagcggtactagtgaactaaaaagcagattattatttgtgctaggtgcactgattgttttccgtattggttctttcattccggttcctggtattgatgcggccgtgctggctcaattacttgaacaacaaaaaggcactatcattgatatgttcaatatgttctctggtggtgcgttgagtcgtgcgtcaatttttgcattaggtatcatgccttatatttcagcatcgattattattcaattattgaccacggttcatcctgctttagcagagttgaagaaagagggagaagcgggaagacgtaaaattagtaagtatacacgttattctactctcgtattagcaactattcaggcaatcggtatttctactggtctacctaatatgctacctgggttagttcctaatttaggctttggtttctattttacagcggtaattagtcttgtaacaggaaccatgtttctaatgtggttaggtgaacaaattacggagcgtggaataggtaatggcatttctttaattatttttgcaggtattgttgcagggttgccttcagcaattggtcaaactattgagcaagctcgtcaagggcaaatgcatctattagttcttttattgatcgcagtaattgtttttgcggtgacttattttgttgttttctttgaaagaggacaaagaagaattaaagtcgagtatgcaaaacgtcaacaaggtcgtcagatagtaggtggtcattcaactcatctaccattaaaagtaaatatggcaggagttattccggcaatttttgcttcaagtattattctttttcctgccacgttaacatcttggtttggacaaggttctaatttggaatggttaactgaattatcgctattattacatccaggacagcctttatatctgattgtttatgctgtggctattatattttttagtttcttttataccgcaatgcaatataatccgcgtgatacagcagataatttgaaaaagtctggcgcatttatacccggaattagaccaggtgaacaaacatcgcgttatattgataaaattatgactcgccttacattaattggtggattatatattacgtttgtatgtttagttccttatattatgacatcagcttggaatgttcagttttattttggtggaacgtctttgttgattgttgtagttgtaattatggatttcatcgtacagattcaaagtcatttaatgtcaactaaatatgaatctgcgttgaaaaaagcaaaccttaaaggttttggacaataaatgtccatatagtaaaaaggataagtaatgaaagttcgtgcttcagtcaagaaaatgtgtcgtaactgtaaaattgttaaacgtgaaggtgttgttcgtgtattatgtagcgaccctaagcataaacagcgtcaaggttaattgatatttttcttgcaaagaaccagctgggtatatataatactcagctcatttatgtccttgatatgctgtttgagtatcctgaaacgggcttttcaagatcagtatatcaaatttaatcaataaaataataggagtgcatagtggcccgtattgcaggcattaacattcctgatcaaaaacatactgtaatcgctttaactgcaatttacggtatcggtaagactcgagctaaggcaatttgtgcagctgcgggtattgctgaagatgtaaagatcagagaattgtctgaagagcagattgataaactgcgtgacgaagttggtaaatttaccgttgaaggtgacttacgtcgtgaagtaacacttaacattaaacgcctattagatttaggttgctatcgtggtttacgtcatcgtcgtggtttaccagtacgtggtcaacgtactaaaactaatgcgcgtacccgtaagggtccacgtaagccgatcaaaaaatagtcggggtaaggttaaatggctaaaacaccagttcgtgcacgtaaacgtgtaaaaaaacaagttgtagatggcgttgctcatattcacgcatctttcaataatacaatcgttacaattactgaccgtcaagggaatgctctagcatgggcaactgcaggtggttcaggtttccgtggttctcgtaaatctaccccgtttgctgcacaagttgcggcagaacgttgtgccgaagttgtaaaagaattcggtttaaagaacttggaagttatggttaaggggccgggtcctggtcgtgaatcaacaatccgtgctttaaatgcagcgggatttcgtatcacgaatattacagatgtgactccgattccacataacggttgtcgtccaccgaagaaacgtcgtgtttaatgacgtcataggatagttggagaaagaaaatggcaagatatttgggtcctaagctcaagctaagtcgccgtgaaggcactgacttattccttaagtctggtgtgcgtgctattgatacaaaatgtaaaattgatacagcacctggtcagcatggtgctcgtaaaccgcgtttgtcagattatggtagtcaattacgtgaaaagcaaaaagttcgccgtatttacggtattttagaacgtcaattccgtaactattataaagaagcaaaccgcttaaaaggtaatactggggagaatttactggtattattggaaggacgattggataacgttgtttatcgcatgggctttgctgcaactcgtgctgaggctcgtcaattagtgagtcataaagcgattgttgtaaatggtcgtgtagttaatatcccatctttccaagtttcagttaatgatgttgttgctgttcgtgaaaaatctaaaaagcaagcacgtattaaagcatcattagaattagcagagcagagagaaaaaccaacttggttggaagtcgaagcagctaaaatggaaggtgtgttcaaacgtgttcctgagcgttctgatttatcagcagacattaacgaacatctgatcgtagagctttactctaaataatagttaaggctttgtagcaaagagaggataaaatgcagggttctgttacagaatttttaaagccacgtttagttgatattgagcaaattagttctactcatgctaaagtgatcttagaaccgttagagcgtggctttggtcatactctaggtaatgcattgcgtcgaattcttctatcttctatgccgggctatgcagttaccgaggtggaaatagatggcgtattgcatgaatatagtagtaaggaaggtgttcaggaggatattattgaggtacttctgaacttaaaaggtctagcggttaaagtacagaataaggataatgtttttctgacactaagcaaatctggaattggccctgttgttgcagctgacattactcatgatggtgatgttgaaatcgtaaatcctgatcatgttatctgccacttaacagacgaaaatgcgtctattaatatgcgtattcgtgtacaacgtggtagagggtatgtgccggcatcatctagagttcattctttagatgaagaacgtccgattggtcgtttgttagttgatgcttgttatagtccagttgatcgtattgcttataatgtacaagcagcacgtgttgaacaacgaactgacttagataagttggtcattgaactggaaacaaatggcacaatcgagccaaaggaagcgatccgtcgtgctgcaacgattttagcagagcaactagatgcctttgttgatttgcgagatgttcgtcaaccagaagttaaggaagaaaaaccggagtttgatccgattttattgcgtcctgttgatgacttagagttgacagttcgttctgctaactgtttgaaagcagaaacaattcattatatcggtgatttggtacagcgtactgaagttgagttactgaaaacacctaatttaggtaaaaaatctcttacagagattaaagatgtgcttgtttcacgcggtctatcacttggtatgcgcctcgaaaattggccaccagcaagtattgctgaagactagtttggtcataggttaaagatttttctgagaaggataaggtcatgcgtcatcgtaagagtggacgtcaactaaatcgtaatagtagccatcgtcaggcactattccgtaatttagctagtgcattggttagtcacgaaattatcaaaactaccttgcctaaagcaaaagaattacgtcgtgtagttgaaccgttaattacattagcgaaagtagatagtgttgcaaaccgccgtttagcttttgctcgtacacgcaacatcgagacagttgcgaaattatttaatgaattaggtccacgttttgcacaacgtgcgggtggttatactcgtattttgaaatgtggtttccgtgctggtgataatgctccaatggcgtacattgagttagttgatcgtccagccttagctgaagaagctaaaacagagtaatttataactcatttaaaaagcccacagtaaaatgtgggctttttgtagtaatcatatttactttctattctattccctatcatcaattcctatcaataaaaaatttccgtttatattacataaacttctgaatccaacattggtaattttgaagggatttttatttggacgttttgtgtagtcaaagctatcatggtgatgaccgtgaaaaatatgctttacttgcattgatgtggctaaattattaataacagaaaatcctaaaggatgaggttttggtgcctcatgacatattagtatgtctgctttttgtttttctaatgcttcaatatcagaaggaaagattgaagttctatgacgcaatggaatacctcctcgccaaattttttccggaggagcgtattggcaatagtggatatgatcaaaaaagagcggtttatttggtggcatccaaatttgcccacgaaacacgcctcctaatccggcaatttttattccttgaatgtcgacaactttaccgtgtaaattacgtgatttccattttataccccataaggcctcatatgctgaaactgttttgctatcatgatttccatggataaaccaaagatcacaaaactgtgccagtttatccagttcatcagaagtagttaattgtaaatcacctaaaataataagagatacatttgcatgttcttgaataaaagggtaaagatgggaataacttccatgtggatcaccggcaaataaaatcataatattattccttaaaaattggaggtgtgattgtttccacggctaagtccaaaagttcttcgttaagtactttttcaacaatatttttcacttgattataacgttccaagtaactgggtgagtcaatttcaatataaggtacactatgcttatctaataatttttttaagagttgttggaagcgttgacgttgtttagcatttcctaagctacgcaagccatcatctacccattgggtattattatttaataaaatggtcacatcaaaaggatattctttgatcatggagtctaagaaagggtgtgcttttccttcatactgaatacaaaatgcctgagttgtaataaagtctgtatctacaattgcaactttgtgtgcatgcctgacggcataatcaatataacgctgatgacctaatgctatttgtggataatcagaatattgcatagcttgttcattaccccccagtttttcaaaaacaaactcacgtccatattcccaagctgatgtagtattaaatactgtagctagcttattaacaagagttgttttaccgctactttctccacctaaaatagcaattgtttttgcaaaaaatgggcgaacttctttaggaatgaatttccaatagtgaaatggattgttacgaatttttgttgcagaaatattaaggaatcggcgttttggatcaactaattcgacttgtaaatttaaatatttttcataaggtactttatcttggatttcactgctaaaaaccacgctaggattaacgtttttttccttgaatagacgttttacttgttcagcccatgcagaccagccattgggataacttggtagaccatcttcaataagatgatgaataacaattttatttttctgatatttaaaaatctgttgcatccaacgtaagcgatcctgtacagttggcattcgtttcattttactgtcataaaatagttttaaatctcgttctgtatcgctacatacaaccacatgaagctcatctactttgctaaatgcttcataaatcatattaatatgaccggtatgaacgggataaaatttgccgaaaataacgcctatttttttgttatcttgttcagtgatctgtagtgctttatgcaatgctgaaagttttgtggcacttggatttttaatttttccactcactaattggttaaaataagcacgagtgatattggcttgtgtacaaagctcattaaccttcagatttaattgcttacgtttttgttgcagatagctgaaactcgacattattttctccttttctatttagggaatatttaatgagtagcataaaaagtgcggtaatcacttagtaagttttttatttttcttgtaattgttctaaacgtttctctagttcaatcagcttttcacgagttcttattaaaacttgtgtttgcacatcaaattcttctcttgtcactatatctagtttagataattgagattgtaagacttgttttagtttcatttcggcatcttgccctaagtcttttacaccttgtgggagagaatcttgaatttgttgcataatttgttctatttttttaggatttagcataataagctccattttgatataaattgccccattgtatgcaatcttattcaaaataaaaacattttttcttattaaacgttaagatatactatacgtgcattctcagggcagggtgaaactccctaccggtggtaaatatttcgatataagcccacgagcacttacttatcttagtaaggtcagcagatttggtgaaaatccaaagccgacagtgatagtctggatgaaagagaatagagcgaggtattatacttatcgttgttgtttttctatttatctgatagaaaaaatccttttatcatcagccctgattctagtatctattaatttatttaaaggagtttactatgaatcagtcattattatctcagtttggtacatctgaagaacgagttaaacgtgcgattgaagctttcaaaagagggaacggagttcttgtccttgatgacgaagatcgggaaaatgagggtgatcttatttttccggctgaaacaatcacagttgaacagatggcaaaattaattcgttatgggagcggaattgtttgcttatgtatcactgatgaactttgccaacagctcgatttgtcaccgatggtacaaaataacacaagtattaatcaaacagcgtttactgtgagtattgaagcggcacaaggtgtatctaccggcgtatctgcacaagatcgtgtaacgactattcaagtcgccattgctgataatgctaagccgcaagaccttagccgtccgggacatgtatttccattaagggctaaaaagggcggtgtgttagcacggcggggacatactgaagccgcagttgatctagcttcttgggcaggtcataagcctgccggggtaatttgtgaaataaccaatgatgatgggagcatggcaagaacactggagatcgtagaatttggcaaaaaatttaattacccagtggtaacaattgaggatcttgtccgctattcatcaagcaaagttgtttagctcgataagtaagagcatcatcaattttttttcgttgttgatgctgtaattaaattgaaatttccctgttcccaacagtttgggtttctgtaaataaaaataaaatgaagactatgcaagatgaaaaatctgttaaactgtgtgctatttaaaatgggttaaaggataaaattattagtaaattaaaacgtgggtttgtcttacatcgacgggattatagtgaaaccagtttgttggtcgagttattcactgaagaacacggacgtttaacagtattggcgaaaggggctcgtgcgaaacgatcggcgtggaaatctttgctacaaccctttacacctttgttacttaattggtctggtcgtggggaattaaaaatattaataaaagcagaggcgatatcattaactttaccgctacaaaccaccgcactttatagtggattttatgttaatgaattaattgctcgtctattggctccggaaaccgcatatccggatctttttcaatattatttgcaatgcttaactgcattggcaagctcaccgcaagaaatcgaaaaaagtttacgcacttttgaatttcaactgttggaagttttaggctatgctgtggatttttgtcattgtgccggttcggggcaaccggtcgatgaaaatatgacctatcgttatcgagaagaaaaaggttttattgcttccttaattaaggataatctgactttttatggacgtgaattattagcttttgagcgtagagaattcgtcgataagaccgtcttgcaggcggcgaaacgttttagccgtattgctttaaaatattatttgggtaataaacctttaaaaagtcgtgaattatttacgcagaatattttacatacaaaataagttttactagatataaatttatggttttactttatcagccaaagaaacaaaaaaaattgagagcagcttttacgaccattgttcaagatttggattatcaaggattaggtgtagcaaaaattcaaggaaaaacgtggtttattgagaacgcattaccacaagagcaagtacaggttcaagttattgaagaaaaacgtcaatatggactgggtcgagttcaaaagattttacaagccagccctttgcgacaaactccaagatgtgcttattatcaaatttgtggcggctgtcaatctcagcatatccctatacatttacaacgtgaaacgaaacaaaaagcgttatttcagcgtttaaccaaactgcaaaaagaggctatagaatttatgccgatgataagtggcgaagcatggcattatcgccgtagagtacgcttaagtttgtactgggacgctaaaagtaaaaaattgaagataggctttcggcaaaaaaattcacaacaaatcgtgaatattcgtcaatgcgatgtgcttgatcccttgttaaatgagttattacctaaattgcatgagttgttgagtacgtggtttaaaccgaaaacactaggacatattgaattagttgccgcagataatggcgtagcgatgttattgagagtaacagaaaaattggctgaacatgaccgcactttattgttggattttgcatttaatcatcaagtgatgttatttgtacaagatgaaaaagagatttgtcatttgcaaggagatttgccttattaccaattagatgatggttctattttacattttgatattcgtgattttattcaggttaatcgccaacttaaccaaaacatggtcaatactgcactggattggttggatttgaagaagaaggataatgtgttggatttattttgtggtatgggaaattttaccttgccgattagccgatatgtgaaaagtgcggtaggaattgagggtgttttacctatggtcgaaaaagcccgtcgtaatggggaacgaaatcattgtcataatgtccaattctaccagtgcgatttaagtcaatcttttactgagcaagaatgggcaaaggttccttttgacaaaatcttactggatccgccgagaagcggtgccgcatttgctttaaatgcattgtgttatttaatggctgaaaaaatattgtatgtgtcttgtaatccggcgacattagtgcgtgatgtggagcttttgcttaagtttggttatcaattaaaaaaagttgcaatgattgatatgttcccacatacaagtcatctggaaagtattagcttatttgaaaggaacagataggaagtaaagttatggttgcagtgcgtggttcacatttacttaatttgcaagattttgtggttgagcaatggagtaaaagtttatctttacctgagaatgttgaacaaaaattaatacaggcttggcgttatgcacagcaaaagtgtcttattgtacaaagtgaatcggagaaaaaaattgtttgttctctgcaagctggtgtggaaatggtggaaattctgcatagtttgaatatggatgcggaaagtttgattactgcaatgctttatccattggtgaaccataaaatgacttcccttatgcaaatcaaagaagattttggcagtaatattagcaagttagtgaaaggcgtagtggaaatggataacattcgccaacttaatgctagtcattcagccaacagtttgcaggtggataatgttcgtcgtatgttattagctatggtagatgattttcgttgtgtcatcattaaacttgcggaacgtattagctatttacgggatgtagaccgcttgtattctgaagaagaaaaagtactggctgcaaaagaatgttctaatatttatgcaccgcttgcgaaccgtttgggtattggtcaattgaaatgggaattagaggattattgtttccgcactttacaccccgatacttaccatgcgattgcaaacttattaaaagaacgtcgtttggaccgagaacaatatatcgcggattttgtgcaggagttacgtggttatctgaatgagaatttggatcaagtagaagtgtatggacgaccaaaacatatttacagtatttggcgtaaaatgcagaaaaaacacttggaatttagtgatttatatgatgtaagagcggtcagaattattgtacaaaaattgcaagactgttattccgctttgggcattgtacatactcatttcaaacatttgcctaaagagtttgatgattatgttgctaacccgaaaccgaacggttatcaatctattcatactgtcgtgttgggcaaaggtggaaagcctattgaagtgcaaattcgtactcaacaaatgcatgatgatgcagaattaggtgttgctgcacattggaaatataaagagggtgtaagtggaggacgttccggctatgaagaaaaaattgcatggttacgcaaattattagcttggcaagatgatattacggattccggtgaagtcatggcggaaatgcgtagtcaagtttttgatgatcgtgtttatgtcttcacgccaaaaggcgaagttgtggatttaccaacaggatctacccccttggattttgcgtatgctattcatagtgaaattgggcatcgttgtattggtgcgaaagttggtgggcgtattgtaccttttacttatcagcttcaaatgggtgatcaaattgagattattactcagaaaaccccgaatccaagccgtgattgggtaaatccgaacttaggttttacgcacacggcgaaagcacgtgctaaaattcagaactggtttaaaaaacaagatcgcgataaaaatattcctgccggaaaagaattgcttgaagttgaaatagcccgtttaggtatttccttaaagcaggtagagcaacacggattgcctcgctataacctgaagaatttagaagacttgtatgccggtattggtggtggagatattcgtctaaatcaacttattaactttttacaaaataaattaattaaggtgagtgcacaacaaacagatgaagaaattttgcgttatgtagccaataaaggtgctcattatgtgagtcaaaaacaaaaaacagagaaaaaaggttacgtgattgttgagggggtaggtaacttaatgtaccatattgcccgttgctgccaacctattccaggtgatgatattatgggctatatcacaatgggaagagggatttctattcaccgtggcgattgtgaacagtttatagagttgcaaaatacacaccctgaacgtgttgttgagtcagtttggggcgaaaattatgccacaggtttccgtatcagtattcgtattatcgccagtgatcgaaacggtttattgcgagatattacaacagtattagctaatgaaaaaattagtgttttgggtgtatcaagccgtgcagatacgaaaaaacaacttgcgactattaatatggaaattgaattaaataatgtacaaattttaagtaaaattttagcaagattagcgaaattagatgacataattgaggcaaaacgtctttagataagttaggcaaaggtaaaggtaaagataatgaaaaaaacaaccggattggagcattttataaaatcaatagtctattccttaaaagggttgaaaagcacgattcaacatgaaagtgcttttcgtcatgagcttgtggtttgttgtattttatttcctttagcgtttcattttgcacaaagcaaaattgagtttgtgcttatgattggttctttattattggtgctggttaccgaattgttgaatagtgcaattgaagttgtggttgatcgtattggaacggaatatcatgagttatccggacgagccaaagaccaaggctcagcagcagtttttgtcgccataatccttgcactatttacttggggagtgattttattttgttagcgtgttgacgtccgccctgccttcaggcagggcggatgtcaatagactagaaacgaacttccacggaagcggcaaaattgcgttttggtgcggtaaaacgattgatgccttcccctttaagtcctacagaacgagcagtaaagcctctggtaaaccataagttataggcactgtcccaagttgtataattacggttgaataagttaaaaatccccatatttaatgtaacatttttactcaggttaacttgtcccgttaaatccactacaaagtaagaaggacttaagaaaggccacggtttcacatttttagcaacatcaccacttttgttaccgccaagttcatattctgtttctatagcatctttggcttttttagccgcactgtaacgaccggttaaactgatactccatttttccgtttcataatcaattcccccaaccacggtccaaggctgaatggatttaagcggatcgccatcatgattttgccctttgctataactccccttaaggcggaatgttaatccatccgacagtcccaatgccgagccgttaacagcaccgctaacttctatccctttaattaccgctttaggctcattgacaaattgagctaacgaaataaactgtttcgaaccaccccaaaaactactaggattgtagtatggatttggcttacatctttcacgctcttggataaagttatgataacgtgtgcggaaaagcccgacgctaaaatgggcatattggttttggaaacggtaggttaattcgtggttcagtgcagtttccggttgtagaaacggatttggtttaaaattattagtagtaccactaccgtcacttacaaaatataaatcttcagcacgaggcactcgaaaaccggtgcttaggcggtagccaatttgatgtgatgggtgtacttgatattccaaccccaattgccaagacagatgggatagttttcttgaggggaagttgattttggcattattgacttgccccttgagttgaggggcgtaattataacgatcataacgtccgccaatagtggctttcaatgtatcggttaaagcgacttcatcaagcaacgatagggaaaaaatacgagattttaccggaacaacttccgtataatttgggcgattttttttcattaaatacgaactagtagagaaacgttgagaattactgttttccaaaaattgatcacgaaattccactttgctggataagcgatgcgtggttcgccataatgctaatggataagttgataattctccacgagtaatagtttgatcttgaatgtactgataggaagcaagttgaaataattgattattcctaatactacgaagagctgaaagttgctcaattttctgttttgccacaaagagttttactgtttctaaccaatataagccattatatcgatattcgagaccataacggcggtatggtgttctgtctgtggcaaatcggttctcatcgttaatccccaatgttttttcttcggtaaatttcttttctgcacgatcttctaaaaatagtgtaaagcgatgggtgttattaatatcgtagccgatttttgttaaccatgaggtggtgtggtagctgagggggttgggtttgccacgacccggaccagtaatatccgcacctttgccattattgattgtttcatgcccccaacgtttggttaattgtgcaaaaccgaagaagcgatcagtcttgaaccccccccctatcacttgacgccattctctattttttgaggtataaccggttttggataagaagccgaaagtgcggtcaggttcgacaaaatcttcaatctctttggtggtaaaagaaaccgcaccccctaaagcaccgctaccattcatgacagaatttgcccctttctgtacttttaccgagctaatattttcatattccgtattattgatattgccattgtgacgttcggtagaataacgtgcggaagtggacattgttgattcggcttgcggtataccatcaacaatcaccgcaacgcgatctttgtcgacaccacgtattgcaaagccgttactaccggaacgaccgccttcaggcacgccaatccccacttcatgacgaaataaatcacgttcattagacaccatatttttccgcaattgttcggaagattgagtagaggaaaaaataggctcaacattcgccacaacggatatttcacccaattcttccgctttgtggggttttgtttttgctggattcgaatcggcaaaacttaatgcaggaaacatcaagctacttgaaagaaataattggttgagaataatagaatacttagatttcaaaatgaaaatctccctgtaaaaaatataatagaaatgagaatggttcttataattataaatgccctaactgtcaagttttttaatcatttttatggaaagagtaagttatttgaataaactatattgttgctaaacaaaacgttgcttgtgaaatgtatttttcactagcatttttaccaagagtttttgtattatatgagcaaaataagtatgccttgattcatatagatataaaagagttgttaaatattaatgcgataggatatgttaaaaaaattaattttacttgtcatcccgatgttgctaacggcttgtgcatcttcgttaaaagtgcttgaactgccgcaagtaaaaacagacagcagactttttgtgattacacaacaatttcctcaatcggaaaaaagtttgctggcgattgaagttcaacctcatcaatggcgttgggtgcaaacagatccgctcggtgcacctattgctcgtcttgttttgagtaaagcggggtggcaaaacgacggtttcgttatgccgaataagcaggcaaaacagcttttttctgcgattgcgacgtattttatgtcgactatgattttcgatgtccagcagatctcggaaaatgaatatgcacaaaaccatcggttaatatggcgattttctccgcaaaaacacggcgttaatattgagttgggggataagtctgtttggtttgtcgaacctttgagactgaattaaaattgtactaattatcagaaaataaaatgacggaaaccttatatttatcaaaacctgcgataatcagtgctatgggcgaagggctgaaaacgcatatagaaatgttattgaatgcggagcattccccgttagtgcattccgataaggtgtttagtcggcatcacattgccggtaaaatcggtgtcttcggcgagataaatttatcattacgcccatttccggacaagcttagtgtacaacaccgtagtcgtaataatcaggtattgtggcacgcattggcagatattgaaccgcaaattgagcaagctgttcagcagtttggcaagcaacgtatcgctgtggttattggtagttcaacaacgggtgtagatgaaaatattcctgttttcaaaggtggagcaagccaacaagattggtcgttagcacctttcaattttcagcaagtttcattttccgctccagcagattttgtggcggaagtttatggtttaagcggtttagtctatggtatttctactgcctgtacttcgggtgcaagagcgttaatcagtgcggctcggttattgaaaaataatttgtgtgatgcggtaatttgtggtggtgtagatacgctttcaccgctaacggtgagcgggttcaattctttatccgtgctttctgcacagcgtacaaatccgttttctcgttatcgcaacgggataaatattggtgaaggtgcggcggtctttttaatgacgaaaacaaagttaaatgatgaaagcctacaattgttcggctatgggtcgagtagtgatgcttatcatatgtcttccccgcatcctgaaggcgagggagcaatttccgcttttgagaatgctttaaaaaacgccaatgttaaggctgaacaggttggttggattaatttgcatggtactggcacggttcaaaatgatcacatggaaagccttgcggttgaaaagatcttcggagataagaccacttgtaccacaactaaggtatatactggacatacgctgggtgcggcaggtgctattgaagcggcgattttgtggggtatgatcagtcgagattataatccaacgggtaaacttcccgcacaattgtgggatcaagaaaaagatgaaaatctgcccgcacttgcgattacagatcgggatagttattggaaaatggatagacgtattggtgtaagcagttcttttgcctttggcgggaataattcggttttggtgttgggggagtagcatggttaatttgcattgtccgattacgcaagtggctcccttgctgccgcatagtaacgatatggtgttgcttgatcttattacggattttggcgaagattttttgatcgctgaggcaaggattaaaagcgataatattcttattcgagaaggtaaactcagtgcattttccggtattgaaattatggctcaaggtgtggctgcttgggcgggatgtatggctgttcaagccaatgagccagtgcgtttagggtatttactcggcacgcgtaaattacatatttaccaagatgagattgcgatcggtagccgtcttcagattaaaataaacatgtccattcaagatgcgacggggtttggtgtatttgattgtcagcttattgatttagccgataatcatgtgattttggaaggggcattgaatgtgtttagtcctaaggaggaacaacaataatggcaaatacagtgcttattaccggctcaagtcgcggtattggcaaagcgattgctttaaaccttgccacacaggggtatgatattgtggtgcattgtcgttctcgtatagcggaggcggagaatgtggcacaagaggtgagagctttagggcaaaatgcaagagtactccaatttgatgtggctgatcgtgaaaaagtgcggtcaattttagaggcggatgtagaagaaaatggtgcgtattacggcatagtacttaatgcagggctaacccgtgataatgcttttccggcattgaccgatgatgattgggatagcgtgttacgcaccaatttagatggtttctataatgtgttacacccgattatgatgccgatgatccgtcgtcgtcaagcggggcgaattgtgtgtattacgtctgtttcaggcttgattggtaaccgtggacaggtgaattacagtgcgtctaaagcggggcttatcggtgcggtcaaggcgttggctattgagttggcaaaacgtaaaatcacggtaaattgtgtggctccggggttaattgacacggatattctggacgaaaatgtcccgatagatgagattttaaaaatgatccctgccggacgcatgggcgatcctgaagaagtcgctcatgccgtgcaatttttaatggatgaaaaagccgcttatattacccgtcaagtgattgcagtgaatggcgggctttgttaaagagcggtaaggatttcaatatttttattcacaattgaacattaacagcaaaaaggatacgaagtgaaacgggtggtagtcacaggaattggcggtatcactgcttttgggaatgattggcagaagataaaaacagcttttcaacgtaaacaaaatgccgtcaaatctatgaatgattgggttgaacgttttcccgaattggatgctcgtttaggtgcggttattgaggattactatcctccgaaacattggaaccgtaagcaattacgcagtttagggcgtgtttctcagctcgtagttgatgccagtgagcgagccttggctaacgcttctttattggacgaagacggtattattttagaatatctgaaagacggtagaatgggtgtagcttgcggttcttctaccggttctaccgatgatattaaagatgcggcggaacttttgatgacaggtaagtcagatggtttcaatgctaacacttatgtacgtatgatgccacataccactgcggcaaatatcggcattttctttggcttaacagggcggattattcccacttcaagtgcttgttcatcaggtagtcaggcgatcggctattcctatgaagccattaaatacggattgattcctatgatgcttgctggcggtggtgaagaattttgtccgtcagaggtttatgttttcgacagcctttatgcggcaagtcgtaataatgacaatccaagccatacgccacgtccatacgataaagcacgtgacggattagtgattggcgagggcggttgtatgtttgtgttggaagagcttgagcatgcattagctcgtggagcgaatattattgccgaagtggtcggttatggtgcaaatagtgacggtagtcatgttacccgcccgcaaaaagagacgatgcagcgttgtatggaattagccctgaaagatgcagggattgaaccgagtaaaattggttatgtcagtgggcatggtaccgctaccgaacaaggcgatattgcggaaacgctggcgacagaagccgtatttgggtatgttcccatgagttctcaaaaaagttatcttggtcatacgttgggagcttgtggtgcattagaagcctggtttagcattgaaatgatgcgagatggctggtttgcaccaacgattaatcttgacaatgtagatgagcgttgtggtaaggtggattatattcaacatgatggacgagaaattcatactgattatgtcatgaacaataatttcgcatttggtggggtgaatacttctcttatttttaaacgctggacggatgaatagtggtaataagtcgctacatttcggggtgtacattatagaaattgctatggaattagctaaaattagcggcgttttgtaaagttgtggatagagaaaaagcgtatggcaaagatgataaatgatgggtgtaatatcgataatgactttgttcaaaagagtattaaacaatgacgcaacaaatctgtaatttttcatttaatcttcatgcgtggaatattgtctgtaataaagagctttccggagaggattggcaacaaggcgagcagtattggatggaaagtgttgctaaacgtgaaactgttgcaccgaaactggcttttttatcgccgttaaaacgtcggcgtttaagtgaaagtgcacgtttattttttgaggcggcatggccgttaaccgaacaagagaataatttgccggtggtgtatgcttcgctgaatggagaaatcaatcgtagctttgccttgtggcattctctcttaactgaaggagatgtgtctcctacttcatttagtctttcggtgcataatgcccttgttggacaatggtctgaaatgcgtcaggttaaaaatgaaacgacggctattaccgccttaaaagatagcttggaaattgccttattagaggcttttctactcttaaatgatggacaagaaaaggtgctggtcgtgctttcggaaacaccgttatcagtgaaatacaatgctcaacccgtggagcgtttgcctttgtcttatgcgttggcgatggtggtggaaaaaggctcgacttatcagcttagtttgcaatcgcaagtcattgacaatacggtgttttttgataatgcacttgcttgggtgcaacagcaatatttgggggcatcccaatggcaaacccaaagtagtcgtggaggaacttggttatggaagaaaaacttgattggctaaggcgttttctcggtacgttatttggttttatattgttcggtttcgtcggcgtgctgtttaaaattatcctttatccttatgcaaagcaatatcccaaggcagatttagctacgcaattaaaaggacgtaaaattgtcagtcgtacttgggcattttttgtgcgttatcttatttgggcgggtattttagaggttcgttaccatggttttgagcgattggggcgtaaaggacagttagttttagctaatcacccctctttgcttgatgtggtgctgatttttagtcaagtgccggagtttaactgcattgtgaaacaagatttgttaaaaaatcctgctatgagcagcccgataaaagcctgtggttttgtgccgaatacagaatcggaagaattattggaaatgagccatcggattttacaagaacaatccttattactttttccggaagggactcgtacaggttgggatggtgtggtgaaattacatcgcggtgcggtttctattgggttgcgtagtgcaaaagtgatcacgccggtggtgattaaaatgaccccgttaaattttaaaaaaggacaaccttggtataaaattcctaaaactaagattacgtatgaactaacagtgggcgaagatatcgatccgcaaaagtggttggcggaaaagcccttgcctattgcctctcgccgtttaaatcaatacttggaagattattttaactcacaaacaaaggactaaataatggaacttgaattacaacttaaacaattaattattgacagccttgcacttgaggatattggtgttgaggatattgacactgatgcaccattatttggtgatgatgggttgggactggattcggtggatgcgttagagctgggattggcagtccaaaaaacgtttggtttacaattggatagcgaacaacaaaacttgcgtaatcattttgaaagtgtggcgactttagcaagttttattcaaagtcagaaacagtagaggaaaagaagtgaaatgacagaacaggaaattcaaaaggtgttgacggaagccttagtttcattatttgaaattgatgcggacaaaattaagcctgaaacaaatttataccaagatttagaaattgacagcattgatgcgattgatttaattgactatatcaaacgccaaaccggttataaattaaaggcggaagatttccgcaatgtgcgtaccgtaagtgatgttattgctgcggttcaaaaaatcagcgaaaacgcatagtcaagttgttgaggttgataaaataacctttggattcaagaccttgaggggggggatagattgatgagtatagaacagcgactcatgcaaagcgagcttgtgcagaatccaatatggctgagtgagacacaagaagaaaatttgcaaatcttcagggcgaaagtaccgcttgatctgtgctatttcaaaggacattttgctaattttcctcttgtgccgggagtcgttgagttgcaatgggtgaaagagaaaatagatgcttactttggcaaagaaatgcagatgaatcgcattgataatttgaaattccaaaaatttcttcgcccaaacgatgaatttgagctcacattaaaatgggaagaaaacaaaaatcgaataggttttcagctcaaaactgagggcgaaatgtgtgccagtggtttcgtgattttcaaaaatggttaaattattcaatttattgattaacttggggttactgcttaccggcattggttatccgctggcgtggttttttgatgaaaaacaccaagggctttcgtatttagtagcaataatggcgttattatgggcaatcaaagcgataaaagcggtcagttttcatcggtttttggcaatcctaatggcgatattgcttggcatcgtttggcttactcgtagtttggaaacaatgtattggtatcctgtcatcatcagtacggcaatgcttattttatttggtggtagcttatttagctcacaatcgcttattgagcgtttcgctcgcctacaagattccaacctttctcctcaagccgttagttacacccgaaaagttaccctagtctggagtggattttttgtgctaaatattaccatttgcaccgcacttatcctcgctggacaatatcactggtgggcatggtactcaggcggagtttcctatgtactaatggggttattgatgtgcatcgagcggttggttcgacaagaggtaatcaaaaatggataagcaacataatcaagggtatgcggattttgctttgcgttgtcagcaaatacgccaacagcttgaggaagatcgggtgaaagcggtggggttatggttagataatgcagatcaatttgcctgcgtgttattggcttgtttgaatgcaaaagtcaatgtgttgttaccgccgaatttactcaatgaaaaccttgaatggttggaacaacattcagcattactctttgataaaaaaatgattgagcaatttgggcgtttgcaaaaaattcaaaaaatccaacctcttttggataagcagaatgaaagtgaaatttggttgaaaacatcaggcagcagcgggcaggcgaagatcattaaaaaaacggcaaagcagatgtggcgggaatctcaagccttagtttctgtcttgccatttaacgccaatgaacaaatttcagtcattggtagcgtcagtttgcaacatctttacggcttgactttccgtatatttttgcctttacaaatgggctggaaattaggtggtgagcagttacattaccctgaatatttactggcagaaagtcgtcattatcgcacgctttggattagtagccctgccttattgagccatctcaacttggcaagtttggaccagcatgtgcagattgcaggtatcatttcatccggcggggcgttacccgaacaaaccgcacttgctttgcgagaggaattgccttgccccgttattgaaatttacggtagtaccgaaaccggtgcgattgcttttcgtcagcaaaccggcgggctttggcaagcgatgccgaacactcggttgggattaaatgatgaagaggcgttgtgggttgaaaatgcatggattgtcggacgagagcaaacggcagatgcggtgcaatttagtgagcatgggtttgaattactgggaagaattgaccgcattatcaaattgggtgataagcgtttgtcattggtgaaaatagaacaagatttgctcaagcattgttttgtacaagattgctacattgcactacattgcctacatcagcgaccactagcttgggttgctttaaataaagaaggcattgcctattttaaacaacaaggacgtcaggcagttatttcacaatttcgccaatatttacgcctgacccaagaaaaatttgctttgcctcggtattggcgatttacggacaaattacctcgcaataaccaatcgaaaatcagccgtttagattttgaaaaaatttgtaccgcacttgagtatgaggtatttgcatgacagcgtttaatcccattgcgatcattccccattataaccattctgcaacggtaggtagcgtcgctgaacagcttaatcaactagggctacctgtattgatcgttgatgatggctcaagtctggaacataaagcagtgattgagcaatttccacaaaatgaacagctttccattttattttgtgaaatcaacggtggtaaaggtgctgcttttaaagcaggcttaaaacagacacaaaaacttggatttagccacgctattcaagtagatgcagatgggcagcataatataattgatgtcaagaaaatgctcgaacaagcggaaaaatcaccgaatgcaatagtatgtggtaaaccgatttatggcaaagatgctccaaaatctcgcttatatgggcgaaaaattaccgatttttggaatgcaatcaatacgttatcctttgatattaaagacgggatgtgtggttttcgaatttatcctattactcaaattatgcccattcttgcacaagagcaaattggtggtggtatggattttgacacagaaattttaatccatagttattggcagaaaattccgcttatttgggttgataccccagtaaaatatgaaaaagatggcatctctcattttcgtggttgggcggataactggctgctcagcaaaatgcacgcacgccttttcttccgtatgctcaaacgactctttacaggaaaaattcgatgaataaacattgggcaaaacaacaagagcgtggtactgccttttttctaaccttaactcgtttaattgtgaagtatttgccattgcccataattcgagcagtgaatttttgggtggtgttatatttttatctcacttctcggcaaaaacggtgctacattgcagaatatcagcaaaaactgaccgctctttttcctgaaactaagttacctaaatatgcggtatttagacaatttctcgcttttggcgaagccattactgatcgtttcgccgtatggcaaaaaaaaattcgttatgaacatcttatcgttgatgatgcggataatctttatgcagatatcagcggcaatggtcgaggacaaattttggtttgctctcattttggcaatattgagatctgtcgggctttgttcggtagcggacagcacgaaaattttaaactgaatgtactggtacataatcgacatgctgcagcatttaataaaacattgggtgatgcaggtgctgatgaattaccgctgattcaagtggaagacctcaatgtacaaaaaatgctggaacttgctgaaaaaattgatcgtggcgaatggattgcgattgccgccgaccgcattcccgtacgtggcgataaaacggagccagtcaattttttgggttctccagccgagtttcctcaaggtgcttggctgctggcaagtttattgaaagtgccgcttaataccatcttttgcatcaaagaacaggggcgttaccgtttgcagcttcgccgttttagtgaaagtattcaaggtcgaggaaaagtgcgtgaacagaatataagaaatgtcatgcaaaaatatgcggatttactggcaaaagaatgtgcaaaatcaccatttttgtggtttaatttctatgatttttggcatcgcaaagattaacttacttttctcaaggagattttatgaaactgatcaaaatattagctttaactttttctgcggttgtgattgttgcttgtgcacctcgtgatacaacccattatttatctattcaggaagccttaagttctcctgaggctaaaaaaatactgaatcctaaaatcaagctttattttggtaaacctgcaccgggtcaagtgattcaaaaaggggcggttaccaacccgaaaacgaatgcggtgaataaaacagataaagaagcgtgccaatgggtattcttatctgcagtgaaacgtttccaagatcaagcggtagctaaaggggtaactaaagtgggtaacctcgtgagttattacaagaaaaaagaatatagtagtaccactaaatatgagtgccatgccggtagaagtattgctggtgtagcattaaaaggcgattttgttaagtaaagctattaataatctaggataaacaagcggtttaatttcttgaaaaaatgagcaaaattaaaccgctcttttgcttaaaatgagacttaaaaaacacatttacgctgaacatttttccgactatgaaatcccattttttgatgtggactccatgtttattatgtggcatggtcattatgtcaaatatttagaaatggctcgctgtgcatttttagaagaaattcactatacctacgatgtgatgcgagaaaaaggttacggctggccaattgttcaacttcatttgaaatatgttaaacctgccgtatttcgccaaaaaattcgggtgcatttagctgttgtagaatacgaaagctgtatccgtattgattacaccattactgatttagccaccaaacaaaaactgacaaagggtagtaccacccaagttgccgttgatatttcaaccggtgaaatgcaattacaaacgccacaatcttggcgtgatgcgatagaaagctatcatgggtttattgctgagtgagagagcgttaatgaaaaaatatctttttgtcttgttaatattattatgttgcaaaaatctttgggctttttctcaggatgatttagtacatttgttacaaaagccacagaatacgcaaggtgaatttagtcaacaacgttatttaaaagccttaaccaaacccattatcacttcaggaaaatttattttaataaaaaataaagggttggtttgggaaacggaaaaaccgtttacacatcaattgaaagtgacggcaaaaggcattagccaatggaatggaacagcatgggaaaaccattctcgtttaggtcagggtgagcaaattaaactattcttaggcttattgtccggcgatattcaagcacttgcgacacaatttgacgtagtgctttcaggagatgaaaaaaattggcaacttcagctcatgcccagcagtttgctgatgaaacaaatttttaatcaaattattattcagggcaatgtagctgtgcaacgtattgaattgcatgaaaaacagggagatcgtaccttgattttgtttaataatcagcagattaaccttccattatcaccctttattcaatctgccttccaataggaatttgcatgcgcaaattattgaccgtttaccgcttaatttttgccggggttttatgtcttgtggtggcgatttttatgtatcatttacaaacaggtaaatggttacaaacggatctacatacacttttgccggacagtcaacactatacaaaaattcaattagaggcagataaacatcaagaacagcaatttaatcagcaagttattgcattggttggacattcacaatcagaagctgcttttaaattgacggaaaaagttgcagaacaatggcaaaaaagtgggttatttcaaacgttatctgtaaaaaatcaaccgaatttagctgaacttcaacagcagattgagttattaaaattagccacactgcctatttcaacacgaaatcagattattcaacagcccgaacgttattttcagcaatatgcagagcaaatcattaacccgttcggttatcaaaatttgctccccttggaacaagactggcttggttttgggcgttttgtattgtcgcaatctcagcagcaaagtcaaattcagtggcatgcagaaacaggtatgctctatgctgttcaacaaggtaagacatgggttttattaacaggcaaaattgttgattcagatttgatcaaacctcagcaaaatttaaccgcacttcttaagcaaaatgcacaatttattcaagaacaacaaggtcaatggttaagtacaggtgcggtgatttttgcggattattcacaacaacaagctaaatatgaaagcacgatcatgggcgggttaggtatcagcctaaccttgcttttactgttgctggttttccgtagcttacgcatattatggttatttttaccgatttctgtaggtatggttgcaggtattactgctactattagttgctttgggcagattcatattttaacgctcgtgattggcacgagtttagtgggggttctgattgatttcccattgcattggcttacatcttctctatttttaagccgatggcgtgccaataaagcgatggcaaaacttcgccttactttttttgtcagcttattggtgactttgctgggttatgctttactgggatttactgctttacctatcctaaaacagaccgcacttttttccggtatggcgttgatttttgctgtcttaacgaccttcttgtatttgcccctatttttccgacattaccagtcagataagtctttgtttttacgaagaattttgaaaataaatttccacgttaagattaattcattattaaataagattttatttgtggttagcacgggtttcattgtagtagggttgcagaaaagctattggcaagatgatattcgtcaatgggttgctatgccaacggaattgattgagcaggcacaaaaaattcgtcaaattaccggcattgatctaagcaaccaatacttattaattactgctgaaaataatgagcaattattgcaaaaagaccaaattctaaccgagaaattacaacggttcgcacaagaaaataatctgataaaatttcagtcattaagccaatggattatgtcaaaaaagcaacaagcggagtttattcaacagctaaaaaatattcctgctgaaagctatagcgtttttgatgaaattggtattccaaaggacatgattcgtcattcgctaaaaaaattggaaaaacagcctcttgtcagcttagaacaagctttaaatacagaattgggaaaagtttggaaaaatctatatttaggtgagcttgatcgaggaaaagtagcaagtattattaaagtatcaggattgaataacccaaaaattcttgagcaaattgttaataatcgggatatttactggcaggataaacctgcccatctcaatcagttgtttgagcaaacccgcaaccaagcggcttggttaaaattgctctcatttggcttggcagctttattgttgtggcgaatgtttggcatatcgcaaacgttgaaaatgctcagtatcccgcttatttcagttgtgtgtacagtcgcaattttaggttggttaaatatcaccatcagtttgtttgctatgtttgggttattattggtgtcggtcattggtattgattacattgcctatatgcaaacagcgaaagagccgttatcaataaaacgttttacgattagccttgcagcacttaccacgcttatttcatttgctttattagggttaagttccactccggcggtagcaagttttggcttgagtgtcagtttgggtgtgttgattagcttaggaatgattttgcgaataaagtgaagtaatggtgaatatattttcacatcctatcttatggctgattaattgcgatagatatatcatttttatggcaaaacaggattgcataagcactaaaactcaaaaagggctgatgtcagccccttgttgttagcatcaaattaaaataatactctcgcacgaatagtgccttcaatttgcttaagtttagccaataattgagcggtatcttctgtttcaacatcgattaccacataaccaatttttgcctcggtttgtaaatattcagctgcaatattgatattttgctccacaaatatttgattgattttatttaaaatccccggacggttatggtgaatatgtaataagcgttttgcattactatgttccggtagagatacttctgggaaatttactgccgacagtgttgaaccattatcggaatatttgacaaatttatttgcgacttcaactccaatattttcttgtgcttcaacagttgaaccgccaatgtgtggtgttaggataacattatcaaaagcacgcaatggcgagataaattcctcttcaatcgaggcaggttctttcgggaatacatcaattgcggcaccacgaatttttttgctttctaacgcctgagttaaagcgtcaatatcaaccactgtgccacgggcagcattgataaaaatacagttcgcctttaattgtgcaatgcgttccgcattcattaaattttttgttgaggaattttccggcaaatgtaatgaaaccacatcacaggtactcaaaagttcttctaagctattcatttgttgtgcattacctaaaggtaattttgtttctatatcatagaaatacacattcatgcctaacgcttctgcaataatacttagttgagatccaatatgaccataaccaataatacccaagcgttttccacgaacctcataagatcccaccatggatttattccataaacctcgatgcacatcggcattggcttgcgggatattacgcattaataataagatctcaccaagcactaattcagccacagatctggtattggcaaacggtgcattgaaaacaggaataccacgtgcttttgccgcctctaaatccacttgatttgtgccgatacaaaaacaaccaattgcaattaattttgttgcttctgctaatatatcctccgttaaagacgttcgagaacgaataccgataaaatgtgcatctttgatagcaatttttaattcatcaggttctaaggcctttcgatgatattcgatattggtatatcctgctgcttttaacacctccagtgcattttggtgtattccctccaaaagcaaaaacttaatttttgatttatctagtgatacttttgttgtcatattgcctctccatatatttaaataattattcaataatttttgtaccctccggcgtacctacaataacaatatctgcagaacgtaaagcaaaaatcccatttgttaccacgccggccacattattcaattctttttccatttctatcggattcataattttaaagttatatacatctaaaataacattaccattatctgtaaccacattttcacgatattcaggtgaaccgcccaacgccactaatttgcgtgcaacttgagagcgagccattggaatcacctctatcggcaaagcgaacgttgagcctaatacatccacttgtttagaactgtctactatacatatgaatttttttgccaatgcggctacaattttttcacgtgtcaatgctgctccgccacctttaatcatcattttttgcggattaatttcatctgcaccatcgacataaatatctaaaccggatacatcatttgcactaaatacctcgataccttgtcggagtaataattcttctgatgcttttgaagctgcgacagcacctttgattgtttcttttattgtacctaatacttcaataaaacaattgacagttgaaccgcttcctacgccaataatgctatcaggtttaacatattgcagtgcagcttgagcagccatttttttcatgcttaactgatccattttttatcctttttttatgattttatgtttatgtcgtacaaagcaaatgtttttataagttcactactttaaaactattcacttaaatacacaagctaatcaggcaaaaactccgttaataattcattaaggaaaagttttccttgttcagtgatttgccaagtgcggttcgtttctgataaatagtttttctctaacgcccaatcaatttgtttttctaccgcactttgtgctaatccagttaacagttcaaattgttgtttttccataggctccaacaaacgaaagcgattcataaaaaactcaaatggacgttctgaaaaagggatatttttttcctcatatagatattcaccacgcatatagcctttagggtgtttcgttttagaaaaacgtaaaatttgtccatcagcaaaactcaatttaccatgtgctccacacccaatggctaaataatcaccaaatctccaataattcaaattgtgttgacattgaaaatcaacttttgcataagcagaggtttcatattgttggtaacctgctttggataacaattgatgaccctgctcaaaaatatcccaaagttcatcttcatcgggtaatttcggcggacgatatgcaaacattgtattaggctcaattgtgagttgataccaagataaatgaggcggttttaaagcaatagcttgctgtaaatcgtccagtgcttgcaccaaagattgattgggtaatccgtgcattaaatccaagttaaaactgtttaatccggaatgttgagcaaaacgcaccgcactttttgcttcaactgcattatgggcacgccccagtctctgtaatttttcattattaaaactttgaatccctatagaaattcgattcactccggcttgtgcatatccgacaaaccgatcgctttcagctgttacaggatttgactcaagcgtaatttcaatattatcctcaaaaggaataagttgtttaatttgattcaataaataatcaatactttgtacagaaaataggctaggagttccgcctccaatgaaaatagaatgcaattttcggttggctattgaggcatgataacgtaccaaatcttgctttaagtcagtaagcaaatgggtaacatattcagtttccggaataagccctttttgtgcatgggagttgaaatcacaataagggcatttttgtacacaccaagggatatgtatatataaacttaatggaggtagctgaatgggaaatagtttaacaagggagaattgtgtcattatttcaaccgctcttttaatactgcgagagctttggctcgatgtgaaattttctttttctccgatgtttccagttcagcaaaagtacaacctgtttcaggatagaaaaataagctgtcataagcaaagccatttgaaccgctttcagaaaaagcaattattccatgacattcaccttcagcaataattggcgatggatcagtgtcatgttgcagcatgacaatacaactcacaaatttggcatgacgctcattaacgggcacattagccagttccgctaataacttctctctatttttctgctccgcctctttgccctcaactccggcatagcgagcggaatataatcctggtgcaccgtttagtacaggaacaaccaatccactgtcatcagcaatcgcaggtaagcctgacatttttgctgcataacgtgcttttagaagtgcattttctacaaaagtcaaacccgtttcttccggactgtcaatacctaaatctttttgtgcaacaacatcaaaaccaaattcagataatacatctgccatttcttttactttcccaggattagctgttgctagtacaattttttgtttcattaccgttcctttttcaatgaataaccagtctgctattttaagcacttcgcaggtattttttaagatgctgttttaagataagtcccctgaatgataaaatatttttgctttctacagaaatatcccctcaacattgttaaaaattgaggggatattgatttatattgtcaaaagttatttggcatgtgtctagaaaatgatgcgatctctatttttttctagtgttgctttgccaatccccttgacttcaagtaactgttcagccgcggtaaatttaccaaatttttcacgatattgaacaattgcctcggcttttttgcttccaattcctattaaagcgtgtttaatttcttccgctgttgcagtattgatgttcaatttatcgttaataatgaccggttcaacttgttgtgttgcttgggctgaactaggtggttgagttggtgtttctgcaaatgcattaaaagcacccaaagcaacacttaacatcaataatgatttgaaaaatgaggttatttttttcattttgtcttccttacagtaaatgataaccaaagtttaaaaaattgaactgttgaattgattcaacaacagacattttgcatggaggcgaaaaacttacgagaaaatcactgcacttttacgatcaggatcgcaaaaataacaaaaggggggagtaaaaagagaatttttaatgaaaaaacgagtatttgctaaaactgaatactcgtttttttgaagagaaattattgacgtactgcgatagcttcaatttcaataccgacatcttttggtaagcgagctacttcaacacaagaacgagctgggaaagttgggtgatgattttctataaagaaacgctcatactcggtatttactgtggcaaattgatttaagtctttcacaaaaacagtggttttaacaatatctgccacagtcaatcctgcttgtgcaagaattgctttaatattttccaaagattggcgagcttgtgccgtaatatctgccggaatttcccctgttgcaggattaaccggaatttgaccggaagttaaaactaaattacctaaatccacagcttgggcataggggccaattgctgccggtgctttttctgtgtgaataaattttgtcattttttctccttaatgcaacgatatttttacgctaaccattgtacgcttttaaaaataaacttaaagcccattcatggcgtttatcaagcgaatttcttcatattgtgccagatcctcgaaaaaaatttctcttgcaataattttcttttgctcaagtaattttgctcgttgtgtaccttctaataacggtttatctggagttatccattgattattttggcgaaaaatcaagtttccaatagagcaatccgttactttgccttgacgaataatcataatttcatcacattcttctttttgttttaagaggttgtttaacaatgttcgatctgaaaatttcaaactgtaatcaatatgatcacagaaaacaggtttaaaagttcgataaactttttgttggtaaggaaagcattgaagaacgtaatcatgatggttgtaatcaatacggcaacgtattaagccttctcggtgggtgaaaagtgcggtatgtttagcaataatttttgctaaatcaaatggttgtaatttcattttgggataaaacttcagcaggcttttttcataacgttgctgatgataggaaatatttttagcttgaccttgttcaattaagatcgtttcaaataaaggaaattgccacattttctgttaataattatcaaatattcatatctgcatcaaaaattatttctctacttaaatcttgagataaagaaataaaagctagctacttagttttcctcactattggataaaccgctgtttaggctctaaatagtccttaattcgcttattttatgaggggtaaatatactttagcacacagctcgttgtattcatcttctatatcactttgaattgtaatgccacctccgctacgaaaataatagccatcgctccgtttctcaataaagcgaatagcgaccgcactttgtaaggtttctccatcaaaaataccaaaaacaccggtgtagtaacctctcttttgctgctccgcttgttgaataatttccaccgttttttcttttggtgcaccgctaatagaacccgccggtaatagtgcggctaaaatatgtccaatattatgtcgccaattttcctctaactcaccacaaatttcggaacttgtttgcaaaattgcacctcgttcagtatgaattttttcaacatagcgaaaacgtttaacttcaatatttttagctacaatagctaaatcattacgcattaaatccacaatggtatagtgttcacgcaactctttttgtgaatttagtaattgttgctcagcattttctaacgttgcatttatcgtgcccttcattggataggtgtaaattttattttcataaatttgaataaacggctcaggcgaaaaacaaataaattcatttttaaacaataacttataacttgcttttgtttgttgaaataactgtattaaactataatttgtttcaattttgctcggataagtaagatttaacaaataagagttacctttttgtaactcgctcttaaccagctcaaatccctgctgataatctttaaatttcataggattaaatgaaaaatgacaatcttttgtggaaaattcaaaatgccaatctacattactttttattccttgcggttgtaaaatagtaaaaaagatattttcttttgctgcttgttcaatgggtaaaataattggtttttgctgttcaaaatcaatcaaaaagaaaaaaggtaatttattttgcccaaaataattcgcttgttgggcaaaatcacgaaattgacttgagttattcaatgacatagtgatgaaaaatttagtaatatacgcaatctgccgattttagcttaagatgaaacatgaacacaaatttattagtcattaataatcatgactcttttacttataacttagtggatctcattcgccgtttaggtacgccttttaaagttgtgaatgtagaggatttatctttggtggaaatagaaaatttttctcacctgttaatttctccgggacctgatgttcctcatgcatatccccaactttttgatttactggaaaaatactatcaatacaaatctattttgggtgtttgcttaggacatcaaactttatgtgaatttttcggcggaaaattgtataatttgcagaatgtacgtcatggacaagctaaacagctaaaagtgcggtctaattcgagactatttagaaatttacccttaacatttcaaattggactttatcattcttgggcagtaagtcctgaaaactttccggaagatcttgaaattactgcgatttgtgatgatgaagtaatcatggcgatgcaacataaaaccttgcccatttacggcgtacaatttcatcccgagtcttatatttcggagtttggtaagcaaatcatacaaaattggctaagtaattgataattataataaattcataataactattaaaaataaaaaaatgatagaaatttcctatgaattttatcaataatatccattttgttagtaaggaattattatttatcatataatcagtaaagacatcaataaacataaataggagaaagcttatgacaacaactatcggcttagatcgcaatagttcaaaacaattagcaacagaattaaataatttattagcaagttatcaaatattctacatgaatgtacgtggctatcattggaatattaaaggtgtaaatttctttgaattacacgcaaaatttgaagagatttatgatgatttagtggtgaaagtagatgaaattgcagaacgtattttaactttaggttataccccaagtaatgcgtttagtgaatatttgacacaatcgcaaattcaggagcatattaatgtaactaacgcacaggactgtttaaacggtaccctacaagggtttaaaacattgttaaaacaacaacgtagtatccttgctattgcatcagatgccaatgatgaaggtaccgcttcgcaaatgagtgattatattaaagaacatgagaaattaatttggatgttcagtgcggcttgtgaaagttgtcatgcttaatttgtgtaatatcacatcattttaaatctaaaagttaaaataaaacctctagctgtgcctagaggttttttcgtttatatgaaaagctaaatattgtgtttatttgccgatacagaaagagctaaaaatattgcctaataaatcatcggaagtaaattgtcctgtaatttcacttagatgatgttgtgctatacgcagttcttctgcgactaattcacctgcataaaattctgtcaactgaatcaatccggcttgtaaatgaatgtcggcttgttctaaggcctctaaatgacgacgacgggctaaaaatcccccctcagtgcagacttgatagcccatggactgttttaaatgctgacgcaacaaatcaacacctttttgtgtttttgccgacaatgaaataacagttaaaccgttttgttcatctaaaacttctgcttcaccacttaaatcagctttgtttcttactatggttaaaggaatatgtggcggtaattttgccataaattcagaccgcactaaatccagttcaacttgattttccgtgctatccaagattaacaaaatacgatcagcctgttcaatttcatcccaagcacgacgaataccaattttttcgacctcatcggttgcatcacgtaaccctgccgtatcaataatatgtaaaggcattccgtcaatatgaatatgttcacgcaaaacatctcgagttgttccagcaatatccgtaacaattgccgcctcacgccctgctagtgtgtttaataaactggattttccggcatttgggcgaccggcaatgactactttcattccttcacgtaaaatagccccttgttttgcctcattttttactttagctaacttggctattatttcacgtaaatgcgtttcaattttaccgtctgcaagaaagtcaatttcttcgtcagggaaatcaattgctgcttcaacataagtgcgtaaataaataactgagtcaactaattcattgattttatttgaaaactcaccttgcaatgattttaacgcagaacgtgctgcttgctccgaactcgcctcaattaaatcagcaattgcttctgcttgagctaaatctaatttatcattaagaaacgcctgttcagaaaattcgcccggtcgtgccaaacgaataccgtcaatttgcaaaatacgttttaataaaagatccatgacgatttgtccgccatgtccttgtaactcaagaacatcttctccggtaaaagaattgggagctttaaaataaagtgctatcccttgatccaatacactaccatcagaatctttaaaaggaagataatttgccatcctaggtgttaaggttttaccgagtacttgttcagcaacctgctgagctaaaggtcctgatacacgtaaaatcccaactccgccacgtccaataggcgttgcttgagctacaatagtatctctactcataatttgtttccaaaagtgcggtcaaaaatcgtatagaattataacaaaaaaggcatcatctaagatgcctttcttttatttaggattatttttttactctggtatgtaagccttttttctccaaaccacgataaattaaccattgttgtgcaatagtaataaggttagaggctaaccaatataacactaagcctgcggggaagaataagaagaacaccatgaaaattaatggcataaacgtcatcactttttgttgcatcggatcggcaacaggtgttggtgacattttttgcaataggaacattgaggcacccattaggatcggtaagataaaatacggatcctgtgcggataaatcttgtacccaaccaaagaatggggcatgacgtaattcaacggcttccataaatgtccaatacaaagcaatgaaaattggcatttgtagaagaattggtaagcaaccgccaagaggattgactttctcttctttgtaaagtttcatcatttcttggctcatacgttggcgatcttcaccaaaacgctcacgcatttcttgcaatttaggttgtaacatacgcatttttgccatcgacgtatattgtgctttggttaacgggtatagaactgcttttactactaaagtgacaccaataattgccagaccccagttttgtacaagagattggattagggttagcaatttaaatagaggtttcgcaataaaccaagcccaaccataatcaacggttaaatccaaatgattagccacatcagccatttgatcttgtaatttcggaccagtccataattgagtatgaatagtttcagttgcaccgttttctattacaatcggagcagatcgataaccaatagaacccaagtgtttcttagtatttgtcagcgtgtacaaggtattattagcatcttgattaggaatccaagcggagacgaaataatgttgcaacaaggcaacccaaccggctttggtatgaatatctaaatctgctttttccatgtcttcaaaactatattttttatagttggtttctgacgatgaataagcaccgccggtataagtcggcattgccatgctacctgaactttcaactagcgtatgagttaattgtgcataaggaactacttcaatcggtttttggctttggttggtaatttcaaaattgacctctaatgcgtaagacccgggttttaatacaaagactttacgatagatcacaccatctttctcaaagaccaaaggcacttttaattcctgctgaccttctgctaacttaaatacatcaccttcaacttggtaatttgcacgaccagcacgactatcaatgccattttttccgactaagccgctttgtgcaatatatactttatccgcattgttctgtaataagacgaaaggtgctgaagaatgtaattctgcatcatagttcaataattcagaaccgatcacgtccccccccaaagtatttacctttaaacggaaaacatcattttctaatgtaataacacgacctttagcctgtgtatcattagcaatatctgacgttgctgtaagtgcggttgagttcacttcagaaacctgagcttgttcagtcacttccggtttaggcgtgttatagtctacttgccattgctgataaataaggaaggaaatgaaaagaagtgccataaataataggctgcgtttagaatccattattcgttctctttgttgttattaatctttgggggaacaggatcgtatccgcccacattaaaaggatgacattttaatatacgtttaactgtaagccaactaccttttactacaccatgcgtttttaatgcttgaataccataacaagaacaagttggcacaaaacgacagcgaggaccaatcagcgggctaatcatcaattgataaatcctaattgcaccaattaagacttttgcaccaaacgaatgtgacgtttccatagcttatccaaagtttgaaataattgctggttatctaaattaccaatacctttctttgttattattacaaaatcataattagccagctgtccttgtaataaacggaaactttcacgagaaatgcgtttaa
